US012006499B2

(12) United States Patent
Doppalapudi et al.

(10) Patent No.: US 12,006,499 B2
(45) Date of Patent: Jun. 11, 2024

(54) UNA AMIDITES AND USES THEREOF

(71) Applicant: Avidity Biosciences, Inc., San Diego, CA (US)

(72) Inventors: Venkata Ramana Doppalapudi, La Jolla, CA (US); Michael Caramian Cochran, La Jolla, CA (US)

(73) Assignee: AVIDITY BIOSCIENCES, INC., San Diego, CA (US)

( * ) Notice: Subject to any disclaimer, the term of this patent is extended or adjusted under 35 U.S.C. 154(b) by 562 days.

(21) Appl. No.: 16/894,648

(22) Filed: Jun. 5, 2020

(65) Prior Publication Data

US 2020/0385725 A1 Dec. 10, 2020

Related U.S. Application Data

(60) Provisional application No. 62/858,289, filed on Jun. 6, 2019.

(51) Int. Cl.
*C07H 21/04* (2006.01)
*C07F 9/6512* (2006.01)
*C07F 9/6561* (2006.01)
*C12N 15/113* (2010.01)

(52) U.S. Cl.
CPC .......... *C12N 15/113* (2013.01); *C07F 9/6512* (2013.01); *C07F 9/65616* (2013.01); *C12N 2310/14* (2013.01); *C12N 2310/314* (2013.01); *C12N 2310/322* (2013.01); *C12N 2310/335* (2013.01); *C12N 2310/3513* (2013.01); *C12N 2320/32* (2013.01)

(58) Field of Classification Search
None
See application file for complete search history.

(56) References Cited

U.S. PATENT DOCUMENTS

| | | | |
|---|---|---|---|
| 4,694,778 A | 9/1987 | Learn et al. | |
| 5,142,047 A | 8/1992 | Summerton et al. | |
| 5,185,444 A | 2/1993 | Summerton et al. | |
| 5,736,557 A | 4/1998 | Hofheinz et al. | |
| 5,889,136 A | 3/1999 | Scaringe et al. | |
| 6,008,400 A | 12/1999 | Scaringe et al. | |
| 6,111,086 A | 8/2000 | Scaringe | |
| 6,821,783 B1 | 11/2004 | Comely et al. | |
| 6,884,869 B2 | 4/2005 | Senter et al. | |
| 7,498,298 B2 | 3/2009 | Doronina et al. | |
| 7,850,975 B2 | 12/2010 | Mullis | |
| 7,943,762 B2 | 5/2011 | Weller et al. | |
| 8,288,352 B2 | 10/2012 | Doronina et al. | |
| 8,501,930 B2 | 8/2013 | Rozema et al. | |
| 8,591,910 B2 | 11/2013 | Mullis | |
| 8,604,184 B2 | 12/2013 | Mullis et al. | |
| 8,609,105 B2 | 12/2013 | Senter et al. | |
| 8,697,688 B2 | 4/2014 | Howard et al. | |
| 8,927,513 B2 | 1/2015 | Manoharan et al. | |
| 8,936,910 B2 | 1/2015 | Mitsch et al. | |
| 9,089,614 B2 | 7/2015 | Lin et al. | |
| 9,127,033 B2 | 9/2015 | Prakash et al. | |
| 9,481,905 B2 | 11/2016 | Chen et al. | |
| 9,725,474 B2* | 8/2017 | Murata ............... | C07F 9/65586 |
| 9,809,817 B2 | 11/2017 | Khvorova et al. | |
| 11,084,844 B2 | 8/2021 | Prakash et al. | |
| 11,208,429 B2* | 12/2021 | Takahashi ............ | C07D 473/18 |
| 2004/0012626 A1 | 1/2004 | Brookins | |
| 2007/0004665 A1 | 1/2007 | McSwiggen et al. | |
| 2011/0293512 A1 | 12/2011 | Violette et al. | |
| 2012/0065169 A1 | 3/2012 | Hanson et al. | |
| 2012/0157511 A1 | 6/2012 | Manoharan et al. | |
| 2013/0028919 A1 | 1/2013 | Howard et al. | |
| 2013/0116420 A1 | 5/2013 | Prakash et al. | |
| 2013/0309256 A1 | 11/2013 | Lyon et al. | |
| 2013/0323836 A1 | 12/2013 | Manoharan et al. | |
| 2014/0127239 A1 | 5/2014 | Howard | |
| 2014/0194610 A1 | 7/2014 | Verdine et al. | |
| 2014/0286970 A1 | 9/2014 | Jeffrey et al. | |
| 2014/0294851 A1 | 10/2014 | Nguyen | |
| 2014/0296321 A1 | 10/2014 | Iversen | |
| 2015/0037360 A1 | 2/2015 | Smith | |
| 2015/0080457 A1 | 3/2015 | Manoharan et al. | |
| 2015/0105539 A1 | 4/2015 | Miao et al. | |
| 2015/0105540 A1 | 4/2015 | Miao et al. | |

(Continued)

FOREIGN PATENT DOCUMENTS

| | | |
|---|---|---|
| EP | 0532423 A1 | 3/1993 |
| EP | 1579015 A2 | 9/2005 |

(Continued)

OTHER PUBLICATIONS

Abramova et al. Novel oligonucleotide analogues based on morpholino nucleoside subunits-antisense technologies: new chemical possibilities. Indian Journal of Chemistry 48B:1721-1726 (2009).

Agarwal et al. A Pictet-Spengler ligation for protein chemical modification. PNAS 110(1):46-51 (2013).

Albarran et al. Efficient intracellular delivery of a pro-apoptotic peptide with a pH-responsive carrier. React Funct Polym 71:261-265 (2011).

Augustyns et al., Incorporation of hexose nucleoside analogues into oligonucleotides: synthesis, base-pairing properties and enzymatic stability. Nucleic Acids Research 20(18):4711-4716 (1992).

Axup et al. Synthesis of site-specific antibody-drug conjugates using unnatural amino acids. PNAS 109(40):16101-16106 (2012).

(Continued)

*Primary Examiner* — Kimberly Chong
(74) *Attorney, Agent, or Firm* — WILSON SONSINI GOODRICH & ROSATI

(57) ABSTRACT

Disclosed herein are compositions and pharmaceutical formulations that comprise a binding moiety conjugated to a modified polynucleic acid molecule and a polymer. Also described herein include methods for treating a disease which utilize a composition or a pharmaceutical formulation comprising a binding moiety conjugated to a polynucleic acid molecule and a polymer.

8 Claims, 5 Drawing Sheets

Specification includes a Sequence Listing.

(56) References Cited

U.S. PATENT DOCUMENTS

| | | |
|---|---|---|
| 2015/0211006 A1 | 7/2015 | Butler et al. |
| 2016/0016983 A1 | 1/2016 | Murata et al. |
| 2016/0046939 A1 | 2/2016 | Prakash et al. |
| 2016/0186185 A1 | 6/2016 | Prakash et al. |
| 2016/0376577 A1 | 12/2016 | Madison et al. |
| 2017/0035796 A1 | 2/2017 | Wooddell et al. |
| 2017/0051286 A1 | 2/2017 | Smith |
| 2017/0081425 A1 | 3/2017 | Colletti et al. |
| 2017/0281795 A1 | 10/2017 | Geall et al. |
| 2019/0192681 A1 | 6/2019 | Geall et al. |
| 2019/0240346 A1 | 8/2019 | Sugo et al. |
| 2019/0298847 A1 | 10/2019 | Geall et al. |
| 2020/0385414 A1 | 12/2020 | Doppalapudi et al. |
| 2021/0095283 A1 | 4/2021 | Geall et al. |
| 2023/0234978 A1 | 7/2023 | Doppalapudi et al. |

FOREIGN PATENT DOCUMENTS

| | | |
|---|---|---|
| EP | 1068241 B1 | 10/2007 |
| EP | 2344637 B1 | 12/2014 |
| EP | 2421971 B1 | 7/2016 |
| EP | 2486141 B1 | 1/2018 |
| JP | 2015536927 A | 12/2015 |
| JP | 2017525705 A | 9/2017 |
| WO | WO-9207065 A1 | 4/1992 |
| WO | WO-9315187 A1 | 8/1993 |
| WO | WO-9734631 A1 | 9/1997 |
| WO | WO-9813526 A1 | 4/1998 |
| WO | WO-2008036127 A2 | 3/2008 |
| WO | WO-2008147824 A2 | 12/2008 |
| WO | WO-2009061941 A2 | 5/2009 |
| WO | WO-2009099942 A2 | 8/2009 |
| WO | WO-2009126933 A2 | 10/2009 |
| WO | WO-2011005860 A2 | 1/2011 |
| WO | WO-2011150408 A2 | 12/2011 |
| WO | WO-2012031243 A2 | 3/2012 |
| WO | WO-2013166155 A1 | 11/2013 |
| WO | WO-2014080251 A1 | 5/2014 |
| WO | WO-2014140317 A2 | 9/2014 |
| WO | WO-2014145090 A1 | 9/2014 |
| WO | WO-2014177042 A1 | 11/2014 |
| WO | WO-2014197854 A1 | 12/2014 |
| WO | WO-2015038426 A1 | 3/2015 |
| WO | WO-2015057699 A2 | 4/2015 |
| WO | WO-2015069587 A2 | 5/2015 |
| WO | WO-2015107425 A2 | 7/2015 |
| WO | WO-2016028649 A1 | 2/2016 |
| WO | WO-2016187425 A1 | 11/2016 |
| WO | WO-2017148879 A1 | 9/2017 |
| WO | WO-2017173304 A1 | 10/2017 |
| WO | WO-2017173408 A1 | 10/2017 |
| WO | WO-2017221883 A1 | 12/2017 |
| WO | WO-2018129384 A1 | 7/2018 |
| WO | WO-2019071028 A1 | 4/2019 |
| WO | WO-2019136180 A2 | 7/2019 |
| WO | WO-2020247818 A1 | 12/2020 |

OTHER PUBLICATIONS

Bell et al. Epidermal Growth Factor Receptor Mutations and Gene Amplification in Non-Small-Cell Lung Cancer: Molecular Analysis of the IDEAL/INTACT Gefitinib Trials. J Clin Oncol 23(31):8081-8092 (2005).

Berge et al. Pharmaceutical Salts. Journal of Pharmaceutical Sciences 66(1):1-19 (Jan. 1977).

Bird et al. Single-chain antigen-binding proteins. Science 242:423-442 (1988).

Blaney et al. Traceless solid-phase organic synthesis. Chem. Rev. 102:2607-2024 (2002.

Bulmus et al. A new pH-responsive and glutathione-reactive, endosomal membrane-disruptive polymeric carrier for intracellular delivery of biomolecular drugs. J Controlled Release 93:105-120 (2003).

Burke et al. SiRNA-mediated knockdown of P450 oxidoreductase in rats: a tool to reduce metabolism by CYPs and increase exposure of high clearance compounds. Pharm. Res. 31(12):3445-3460 (2014).

Casi et al. Site-specific traceless coupling of potent cytotoxic drugs to recombinant antibodies for pharmacodelivery. J Am Chem Soc 134(13):5887-5892 (2012).

Castaneda et al. Acid-cleavable thiomaleamic acid linker for homogeneous antibody-drug conjugation, Chem. Commun. 49:8187-8189 (2013).

Clackson et al. Making antibody fragments using phage display libraries. Nature 352(6336):624-628 (1991).

Colberre-Garapin et al. A new dominant hybrid selective marker for higher eukaryotic cells. J Mol Biol 150:1-14 (1981).

Cole et al. The EBV-hybridoma technique and its application to human lung cancer. In, Monoclonal Antibodies and Cancer Therapy (vol. 27, UCLA Symposia on Molecular and Cellular Biology, New Series) (eds. R.A. Reisfeld and S.Sell), New York: Alan R. Liss, Inc. pp. 77-96 (1985).

Collis, Aec. The synthesis of vinylphosphonate-linked RNA. [Ph.D. Thesis] Retrieved from http://eprints.nottingham.ac.uk/10541/1/Alana_Collis_Thesis.pdf (2008).

Crouse et al. Expression and amplification of engineered mouse dihydrofolate reductase minigenes. Mol Cell Biol 3(2):257-266 (1983).

Dawson et al. Modulation of Reactivity in Native Chemical Ligation through the Use of Thiol Additives. J. Am. Chem. Soc. 119:4325-4329 (1997).

Dawson et al. Synthesis of proteins by native chemical ligation. Science 266(5186):776-779 (1994).

Dimasi et al. Development of a trispecific antibody designed to simultaneously and efficiently target three different antigens on tumor cells. Mol Pharm 12(9):3490-3501 (2015).

Donner et al. Co-administration of an excipient oligonucleotide helps delineate pathways of productive and nonproductive uptake of phosphorothioate antisense oligonucleotides in the liver. Nucleic Acid Therapeutics 27(4): 209-220 (2017).

Duncan et al. A polymer-Triton X-100 conjugate capable of pH-dependent red blood cell lysis: a model system illustrating the possibility of drug delivery within acidic intracellular compartments. J Drug Target 2:341-347 (1994).

Elkayam et al., siRNA carrying an (E)-vinylphosphonate moiety at the 5' end of the guide strand augments gene silencing by enhanced binding to human Argonaute-2. Nucleic Acids Research 45(6):3528-3536 (2017).

El-Sayed et al. Rational design of composition and activity correlations for pH-responsive and glutathione-reactive polymer therapeutics. J Control Release 104:417-427 (2005).

Flanary et al. Antigen delivery with poly(propylacrylic acid) conjugation enhanced MHC-1 presentation and T-cell activation. Bioconjugate Chem. 20:241-248 (2009).

Goldspiel et al. Human gene therapy. Clin Pharm 12:488-505 (1993).

Griffey et al. 2'-0-aminopropyl ribonucleotides: a zwitterionic modification that enhances the exonuclease resistance and biological activity of antisense oligonucleotides, J. Med. Chem. 39(26):5100-5109 (1997).

Hackeng et al. Protein synthesis by native chemical ligation: Expanded scope by using straightforward methodology. PNAS USA 96:10068-10073 (1999).

Hanes et al. In vitro selection and evolution of functional proteins by using ribosome display. PNAS USA 94:4937-4942 (1997).

Hejesen et al. A traceless aryl-triazene linker for DNA-directed chemistry. Org Biomol Chem 11(15):2493-2497 (2013).

Henry et al. PH-responsive poly(styrene-alt-maleic anhydride) alkylamide copolymers for intracellular drug delivery. Biomacromolecules 7:2407-2414 (2006).

Huse et al. Generation of a large combinatorial library of the immunoglobulin repertoire in phage lambda. Science 246(4935): 1275-1281 (1989).

Huston et al. Protein engineering of antibody binding sites: recovery of specific activity in an anti-digoxin single-chain Fv analogue produced in *Escherichia coli*. PNAS USA 85:5879-5883 (1988).

(56) References Cited

OTHER PUBLICATIONS

Jones et al. Poly(2-alkylacrylic acid) polymers deliver molecules to the cytosol by pH-sensitive disruption of endosomal vesicles. Biochem J 372:65-75 (2003).

Khormaee et al. Edosomolytic anionic polymer for the cytoplasmic delivery of siRNAs in localized in vivo applications. Adv Funct Mater 23:565-574 (2013).

Kohler et al. Continuous cultures of fused cells secreting antibody of predefined specificity. Nature 256:495-497 (1975).

Koizumi. ENA oligonucleotides as therapeutics. Curr Opin Mol Ther 8(2):144-149 (2006).

Kozbor et al. The production of monoclonal antibodies from human lymphocytes. Immunology Today 4:72-79 (1983).

Kutmeier et al. Assembly of humanized antibody genes from synthetic oligonucleotides using a single-round PCR. BioTechniques 17:242 (1994).

Lowy et al., Isolation of transforming DNA: Cloning the hamster aprt gene. Cell 22:817-823 (1980).

Lyon et al. Self-hydrolyzing maleimides improve the stability and pharmacological properties of antibody-drug conjugates. Nat. Biotechnol. 32(10): 1059-1062 (2014).

McEnaney et al. Antibody-recruiting molecules: an emerging paradigm for engaging immune function in treating human disease. ACS Chem Biol. 7(7):1139-1151 (2012).

Miller et al., Stabilin-mediated cellular internalization of phosphorothioate-modified antisense oligonucleotides (ASOs). https://digitalcommons.unl.edu/cgi/viewcontent.cgi?filename=0&article=1019&context=ucareresearch (2016).

Morgan et al. Human gene therapy. Ann Rev Biochem 62:191-217 (1993).

Morrison et al. Chimeric human antibody molecules: mouse antigen-binding domains with human constant region domains. PNAS USA 81(21):6851-6855 (1984).

Mulligan et al. Selection for animal cells that express the *Escherichia coli* gene coding for xanthine-guanine phosphoribosyltransferase. PNAS USA 78(4):2072-2076 (1981).

Mulligan. The basic science of gene therapy. Science 260(5110): 926-932 (1993).

Naisbitt et al. Disposition of amodiaquine and related antimalarial agents in human neutrophils: implications for drug design. J Pharmacol Exp Ther 280:884-893 (1997).

Neuberger et al. Recombinant antibodies possessing novel effector functions. Nature 312(5995):604-608 (1984).

Obika et al. Synthesis of 2'-O,4'-C-methyleneuridine and -cytidine. Novel bicyclic nucleosides having a fixed C3'-endo sugar puckering. Tetrahedron Lett. 38(50):8735-8738 (1997).

O'Hare et al. Transformation of mouse fibroblasts to methotrexate resistance by a recombinant plasmid expressing a prokaryotic dihydrofolate reductase. PNAS USA 78:1527-1531 (1981).

PCT/US2018/054444 International Search Report and Written Opinion dated Feb. 15, 2019.

PCT/US2019/012223 International Search Report and Written Opinion dated Jul. 5, 2019.

Pei et al. Quantitative evaluation of siRNA delivery in vivo. RNA 16:2553-2563 (2010).

Santerre et al. Expression of prokaryotic genes for hygromycin B and G418 resistance as dominant-selection markers in mouse L cells. Gene 30(1-3): 147-156 (1984).

Skerra et al. Assembly of a functional Immunoglobulin Fv fragment in *Escherichia coli*. Science 240(4855):1038-1041 (1988).

Strop et al. Location matters: site of conjugation modulates stability and pharmacokinetics of antibody drug conjugates. Chem Biol 20(2):161-167 (2013).

Suriano et al. Beta-catenin (CTNNB1) gene amplification: a new mechanism of protein overexpression in cancer. Genes Chromosomes Cancer 42(3):238-246 (2005).

Szybalska et al. Genetics of human cell line. IV. DNA-mediated heritable transformation of a biochemical trait. PNAS USA 48:2026-2034 (1962).

Takeda et al. Construction of chimaeric processed immunoglobulin genes containing mouse variable and human constant region sequences. Nature 314(6010):452-454 (1985).

Talasila et al. EGFR Wild-type Amplification and Activation Promote Invasion and Development of Glioblastoma Independent of Angiogenesis. Acta Neuropathol. 125(5):683-698 (2013).

Tolstoshev. Gene Therapy, Concepts, Current Trials and Future Directions. Ann. Rev. Pharmacol. Toxicol. 32:573-596 (1993).

Valtorta et al. KRAS gene amplification in colorectal cancer and impact on response to EGFR-targeted therapy. Int J Cancer 133:1259-1266 (2013).

Ward et al. Binding activities of a repertoire of single immunoglobulin variable domains secreted from *Escherichia coli*. Nature 341(6242):544-546 (1989).

Wigler et al. Transfer of purified herpes virus thymidine kinase gene to cultured mouse cells. Cell 11:223-232 (1977).

Wigler et al. Transformation of mammalian cells with an amplifiable dominant-acting gene. PNAS USA 77:3567-3570 (1980).

Wu et al. Building complex glycopeptides: Development of a cysteine-free native chemical ligation protocol. Angew. Chem. Int. Ed. 45:4116-4125 (2006).

Wu et al. Delivery systems for gene therapy. Biotherapy 3:87-95 (1991).

Wu et al. Site-specific chemical modification of recombinant proteins produced in mammalian cells by using the genetically encoded aldehyde tag. PNAS USA 106(9):3000-3005 (2009).

Yessine et al. Characterization of the membrane-destabilizing properties of different pH-sensitive methacrylic acid copolymers. Biochimica et Biophysica Acta 1613:28-38 (2003).

Zhang et al. A remote arene-binding site on prostate specific membrane antigen revealed by antibody-recruiting small molecules. J Am Chem Soc. 132(36):12711-12716 (2010).

PCT/US2020/036369 Invitation to Pay Additional Fees dated Aug. 13, 2020.

PCT/US2020/036420 International Search Report and Written Opinion dated Oct. 5, 2020.

PCT/US2020/036420 Invitation to Pay Additional Fees dated Aug. 14, 2020.

Pubchem CID 89552245. Feb. 13, 2015, pp. 1-10. Retrieved from the Internet< url:< a href="https://pubchem.ncbi.nlm.nih.gov/compound/89552245">https://pubchem.ncbi.nlm.nih.gov/compound/89552245</url:<a>.

Co-pending U.S. Appl. No. 17/364,754, inventors Geall; Andrew John et al., filed on Jun. 30, 2021.

Co-pending U.S. Appl. No. 17/364,765, inventors Geall; Andrew John et al., filed on Jun. 30, 2021.

Debacker et al. Improving gene silencing oligonucleotides by incorporation of peptide nucleic acids. Thesis (Doctoral) (Sep. 1, 2017) Retrieved from the Internet: URL:https://eprints.soton.ac.uk/422159/ [retrieved on Jul. 26, 2021].

Haraszti et al. 5'-Vinylphosphonate improves tissue accumulation and efficacy of conjugated siRNAs in vivo. Nucleic Acids Res. 45(13):7581-7592 (2017).

Haringsma et al. MRNA knockdown by single strand RNA is improved by chemical modifications. Nucleic Acids Res 40(9):4125-4136 (2012).

Kang et al. HER2 RNA Aptamer- and Cell Penetrating Peptide-Mediated Delivery of Multimeric Antisense Strands of siRNAs for Gene Silencing: Multimeric antisense strands of siRNAs. Bull. Korean Chem. Soc. 37(9):1440-1444 (2016).

Kumar et al. 5'-Morpholino modification of the sense strand of an siRNA makes it a more effective passenger. Chemical Comm 55(35):5139-5142 (2019) Retrieved from the Internet: URL:https://pubs.rsc.org/en/content/articlepdf/2019/cc/c9cc00977a.

Parmar et al. 5'-(E)-Vinylphosphonate: A Stable Phosphate Mimic Can Improve the RNAi Activity of siRNA-GalNAc Conjugates. Chembiochem 17(11):985-989 (2016).

PCT/US2020/036369 International Search Report and Written Opinion dated Oct. 20, 2020.

Prakash et al. Synergistic effect of phosphorothioate, 5'-vinylphosphonate and GalNAc modifications for enhancing activity of synthetic siRNA. Bioorg Med Chem Lett 26(12):2817-2820 (2016).

(56) References Cited

OTHER PUBLICATIONS

Shukla et al. Exploring Chemical Modifications for siRNA Therapeutics: A Structural and Functional Outlook. ChemMedChem 5(3):328-349 (2010).
U.S. Appl. No. 16/152,324 Office Action dated Oct. 16, 2020.
Walker et al. Improved cellular delivery of antisense oligonucleotides using transferrin receptor antibody-oligonucleotide conjugates. Pharmaceutical research 12(10): 1548-1553 (1995).
Zhang et al. RNA interference in mammalian cells by siRNAs modified with morpholino nucleoside analogues. Bioorg Med Chem 17(6):2441-2446 (2009).
Habus et al. Oligonucleotides containing acyclic nucleoside analogues with carbamate internucleoside linkages. Nucleosides, Nucleotides & Nucleic Acids 14(9-10):1853-1859 (1995).
Karlsen et al. Pyrene-modified unlocked nucleic acids: synthesis, thermodynamic studies, and fluorescent properties. Chembiochem 13(4):590-601 (2012).
Karlsen et al. Synthesis of an unlocked nucleic acid terpyridine monomer and binding of divalent metal ion in nucleic acid duplexes. J Org Chem 74(22):8838-8841 (2009).
Prakash et al. Identification of metabolically stable 5'-phosphate analogs that support single-stranded siRNA activity. Nucleic Acids Res. 43(6):2993-3011 (2015).
U.S. Appl. No. 16/894,589 Office Action dated Feb. 9, 2022.
U.S. Appl. No. 16/894,589 Office Action dated Jul. 18, 2022.
U.S. Appl. No. 17/364,754 Office Action dated Oct. 29, 2021.
U.S. Appl. No. 17/364,765 Office Action dated May 17, 2023.
U.S. Appl. No. 17/364,765 Office Action dated Oct. 23, 2023.
Watts et al. Chemically modified siRNA: tools and applications. Drug Discov Today 13(19-20):842-855 (2008).

\* cited by examiner

UNA AMIDITES AND USES THEREOF

CROSS-REFERENCE

This application claims benefit of U.S. Provisional Patent Application No. 62/858,289 filed Jun. 6, 2019, which is incorporated herein by reference in its entirety.

SEQUENCE LISTING

The instant application contains a Sequence Listing which has been submitted electronically in ASCII format and is hereby incorporated by reference in its entirety. Said ASCII copy, created on Jun. 5, 2020, is named 45532-735_201_SL.txt and is 3,172,187 bytes in size.

BACKGROUND OF THE DISCLOSURE

Gene suppression by RNA-induced gene silencing provides several levels of control: transcription inactivation, small interfering RNA (siRNA)-induced mRNA degradation, and siRNA-induced transcriptional attenuation. In some instances, RNA interference (RNAi) provides long lasting effect over multiple cell divisions. As such, RNAi represents a viable method useful for drug target validation, gene function analysis, pathway analysis, and disease therapeutics.

SUMMARY OF THE DISCLOSURE

Disclosed herein, in certain embodiments, is a compound according to Formula (II):

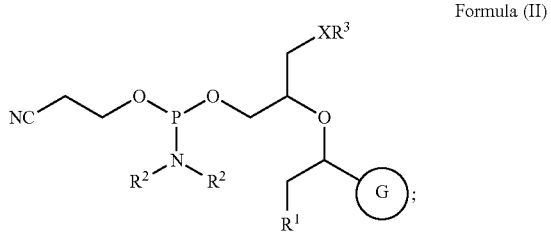

Formula (II)

wherein,
Ring G is

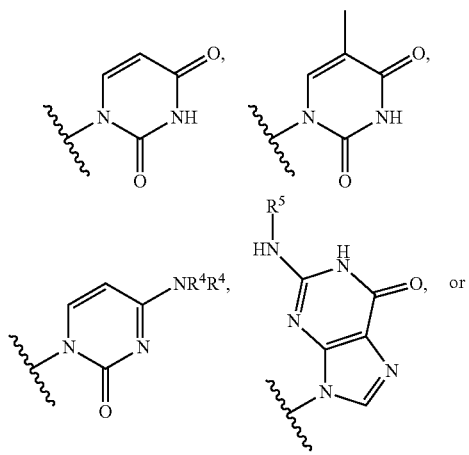

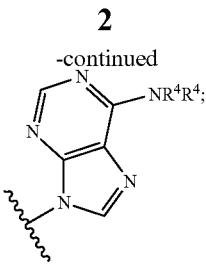

X is O, NH, or C(=O);

$R^1$ is hydrogen, deuterium, halogen, substituted or unsubstituted $C_1$-$C_{10}$ alkyl, substituted or unsubstituted $C_2$-$C_{10}$ alkenyl, substituted or unsubstituted $C_2$-$C_{10}$ alkynyl, substituted or unsubstituted $C_1$-$C_{10}$ fluoroalkyl, substituted or unsubstituted $C_1$-$C_{20}$ heteroalkyl, substituted or unsubstituted cycloalkyl, substituted or unsubstituted heterocycloalkyl, substituted or unsubstituted aryl, substituted or unsubstituted heteroaryl, substituted or unsubstituted —O-aryl, —$OR^6$, —C(=O)$R^6$, —C(=O)$OR^6$, —C(=O)$NR^7R^7$, —$OCH_2$C(=O)$R^6$, —$OCH_2$C(=O)$OR^6$, or —$OCH_2$C(=O)$NR^7R^7$;

each $R^2$ is independently hydrogen, deuterium, or substituted or unsubstituted $C_1$-$C_{10}$ alkyl;

or two $R^2$ are taken together with the nitrogen atom to which they are attached to form a substituted or unsubstituted $C_3$-$C_{10}$ heterocycloalkyl;

$R^3$ is hydrogen, 4,4'-dimethoxytrityl (DMT), —$R^6$, —$OR^6$, or —$NR^7R^7$;

each $R^4$ is independently hydrogen, substituted or unsubstituted $C_1$-$C_6$alkyl, substituted or unsubstituted aryl, or substituted or unsubstituted benzoyl;

$R^5$ is —C(=O)$R^6$;

each $R^6$ and $R^7$ are independently hydrogen, substituted or unsubstituted $C_1$-$C_6$alkyl, substituted or unsubstituted $C_1$-$C_6$fluoroalkyl, substituted or unsubstituted $C_3$-$C_6$cycloalkyl, substituted or unsubstituted heterocycloalkyl, substituted or unsubstituted aryl, or substituted or unsubstituted heteroaryl.

In some instances, $R^1$ is halogen, substituted or unsubstituted $C_1$-$C_{10}$ alkyl, substituted or unsubstituted $C_1$-$C_{10}$ fluoroalkyl, substituted or unsubstituted $C_1$-$C_{20}$ heteroalkyl, substituted or unsubstituted aryl, substituted or unsubstituted heteroaryl, substituted or unsubstituted cycloalkyl, or substituted or unsubstituted heterocycloalkyl, substituted or unsubstituted —O-aryl, —OH, —$OR^6$, —C(=O)$R^6$, —C(=O)$OR^6$, —C(=O)$NR^7R^7$, —$OCH_2$C(=O)$R^6$, or —$OCH_2$C(=O)$OR^6$, or —$OCH_2$C(=O)$NR^7R^7$. In some instances, $R^1$ is halogen, substituted or unsubstituted $C_1$-$C_{10}$ alkyl, substituted or unsubstituted $C_1$-$C_{20}$ heteroalkyl, substituted or unsubstituted —O-aryl, —$OCH_2$C(=O)$R^6$, or —$OCH_2$C(=O)$OR^6$, or —$OCH_2$C(=O)$NR^7R^7$. In some instances, $R^1$ is halogen or substituted or unsubstituted $C_1$-$C_{20}$ heteroalkyl.

In some instances, $R^1$ is

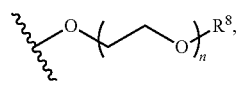

where n is 0, 1, 2, 3, 4, or 5, and $R^8$ is hydrogen or substituted or unsubstituted $C_1$-$C_3$ alkyl. In some embodiments, $R^8$ is substituted or unsubstituted $C_1$-$C_3$ alkyl. In some embodiments, $R^8$ is methyl or ethyl. In some embodiments, n is 1 or 2.

In some instances, $R^1$ is —OCH$_2$C(=O)NR$^7$R$^7$; wherein each $R^7$ is independently hydrogen or substituted or unsubstituted C$_1$-C$_3$ alkyl.

In some instances, Ring G is

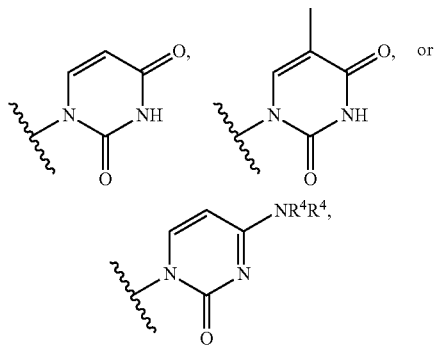

and each $R^4$ is independently hydrogen, or substituted or unsubstituted benzoyl. In some instances, Ring G is

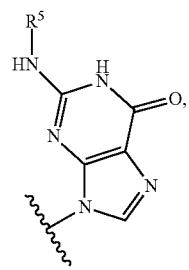

and $R^5$ is —C(=O)CH(CH$_3$)$_2$. In some instances, Ring G is

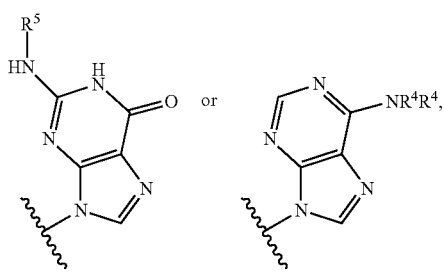

wherein each $R^4$ is independently hydrogen or substituted or unsubstituted benzoyl; and $R^5$ is —C(=O)R$^6$.

In some embodiments, each $R^2$ is independently hydrogen, deuterium, or substituted or unsubstituted C$_1$-C$_{10}$ alkyl. In some embodiments, each $R^2$ is independently substituted or unsubstituted C$_1$-C$_{10}$ alkyl. In some embodiments, each $R^2$ is independently isopropyl. In some embodiments, two $R^2$ are taken together with the nitrogen atom to which they are attached to form a substituted or unsubstituted C$_3$-C$_{10}$ heterocycloalkyl. In some embodiments, X is O, and $R^3$ is 4,4'-dimethoxytrityl (DMT).

In certain embodiments, described herein is a compound according to Formula (IIa):

(Formula IIa)

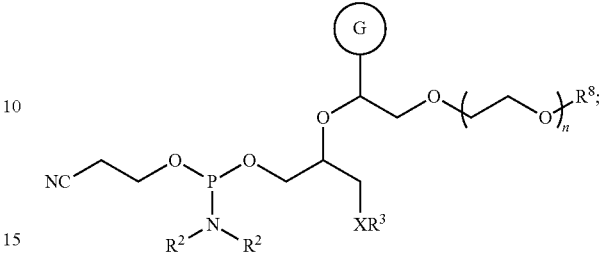

wherein: Ring G is

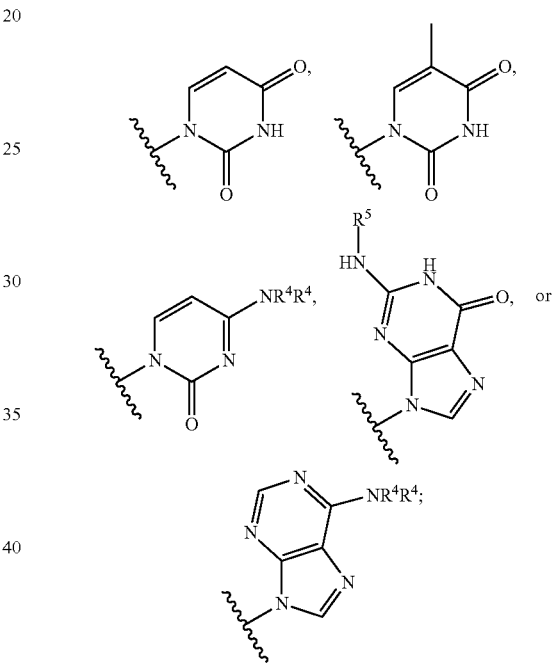

X is O, NH, or C(=O);

n is 0, 1, 2, 3, or 4;

$R^8$ is substituted or unsubstituted C$_1$-C$_6$ alkyl;

each $R^2$ is independently hydrogen, deuterium, or substituted or unsubstituted C$_1$-C$_{10}$ alkyl;

or two $R^2$ are taken together with the nitrogen atom to which they are attached to form a substituted or unsubstituted C$_3$-C$_{10}$ cycloalkyl;

$R^3$ is hydrogen, 4,4'-dimethoxytrityl (DMT), —R$^6$, —OR$^6$, or —NR$^7$R$^7$.

each $R^4$ is independently hydrogen, substituted or unsubstituted C$_1$-C$_6$ alkyl, substituted or unsubstituted aryl, or substituted or unsubstituted benzoyl;

$R^5$ is —C(=O)R$^6$;

each $R^6$ and $R^7$ are independently hydrogen, substituted or unsubstituted C$_1$-C$_6$ alkyl, substituted or unsubstituted C$_1$-C$_6$ fluoroalkyl, substituted or unsubstituted C$_3$-C$_6$ cycloalkyl, substituted or unsubstituted heterocycloalkyl, substituted or unsubstituted aryl, or substituted or unsubstituted heteroaryl.

In some instances, Ring G is

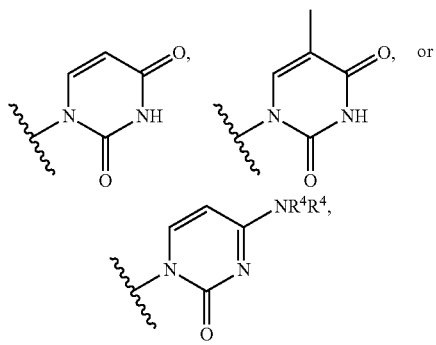

and each $R^4$ is independently hydrogen, acetyl isobutyl or substituted or unsubstituted benzoyl. In some instances Ring G is

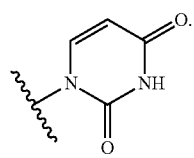 [SMILES: *n1ccc(=O)[nH]c1=O]

In some instances, Ring G is

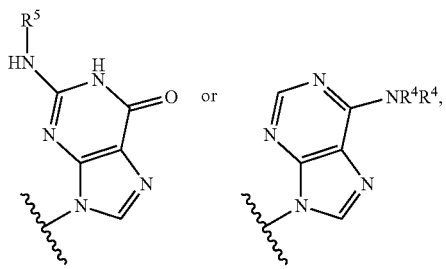

and each $R^4$ is independently hydrogen or substituted or unsubstituted benzyl; and $R^5$ is —C(=O)$R^6$. In some instances, Ring G is

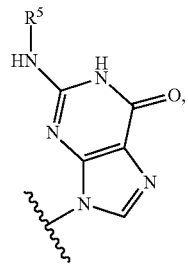

and $R^5$ is —C(=O)CH(CH$_3$)$_2$.

In some instances, $R^6$ is substituted or unsubstituted $C_1$-$C_6$ alkyl. Alternatively and/or additionally, $R^5$ is methyl or ethyl. Alternatively and/or additionally, n is 1 or 2. In some embodiments, n is 1. In some embodiments, each $R^2$ is independently hydrogen, deuterium, or substituted or unsubstituted $C_1$-$C_{10}$ alkyl. In some embodiments, each $R^2$ is independently substituted or unsubstituted $C_1$-$C_{10}$ alkyl. In some embodiments, each $R^2$ is independently isopropyl. In some embodiments, two $R^2$ are taken together with the nitrogen atom to which they are attached to form a substituted or unsubstituted $C_3$-$C_{10}$ heterocycloalkyl. In some instances, $R^3$ is 4,4'-dimethoxytrityl (DMT).

In some instances, the compound is selected from

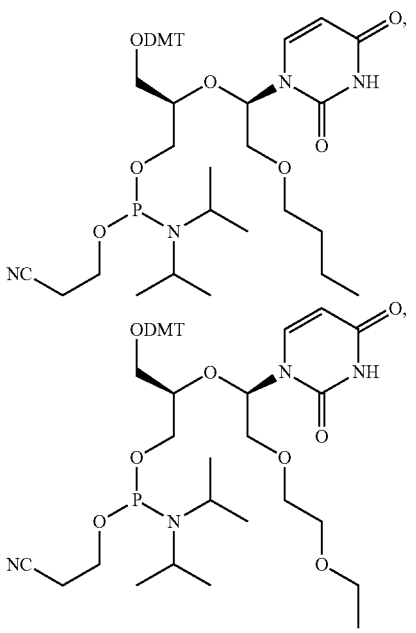

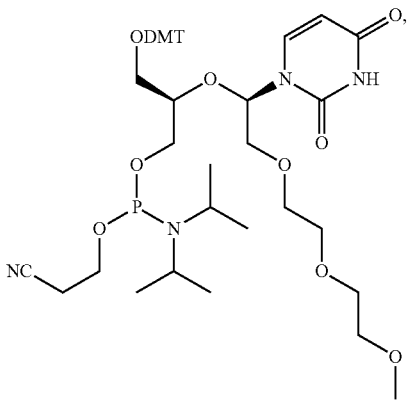

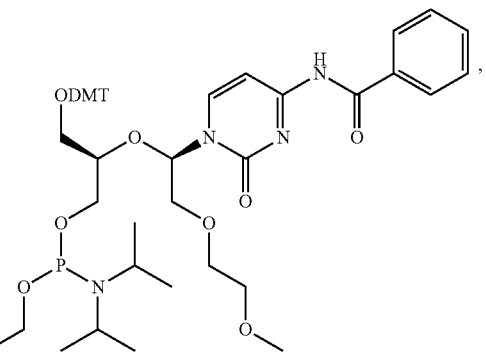

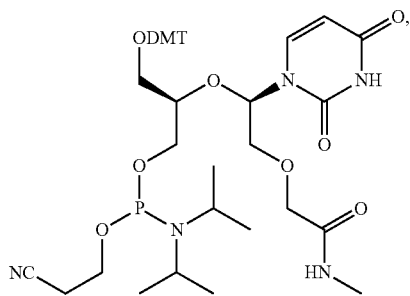

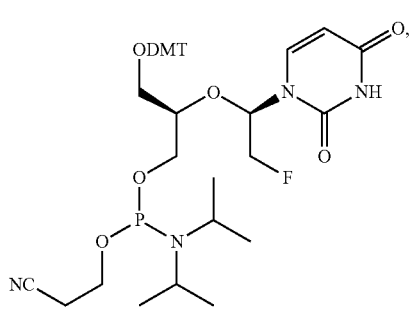

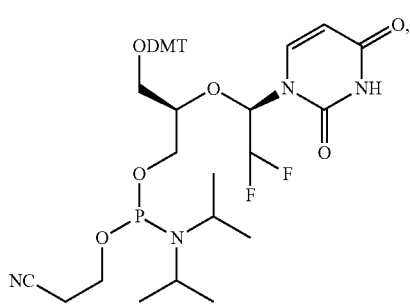

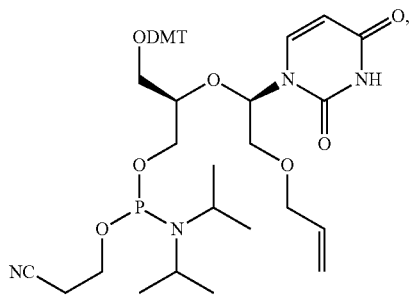

In some embodiments, the compound is suitable for the synthesis of oligonucleotides.

In certain embodiments, disclosed herein is an oligonucleotide comprising a compound of Formula (II) or Formula (IIa).

Disclosed herein, in certain embodiments, are compositions and pharmaceutical formulations that comprise a binding moiety conjugated to a polynucleic acid molecule and optionally a polymer. Thus, disclosed herein includes an oligonucleotide conjugate of Formula (I): A-B, where A is a binding moiety, and B is an oligonucleotide comprising a compound of, or a compound derived from Formula (II-1), (II-2), or (II-3), -continued

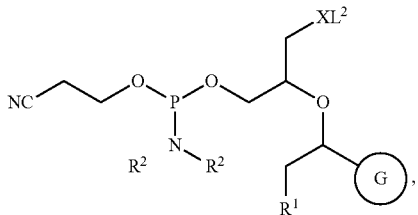

(II-3)

where Ring G is

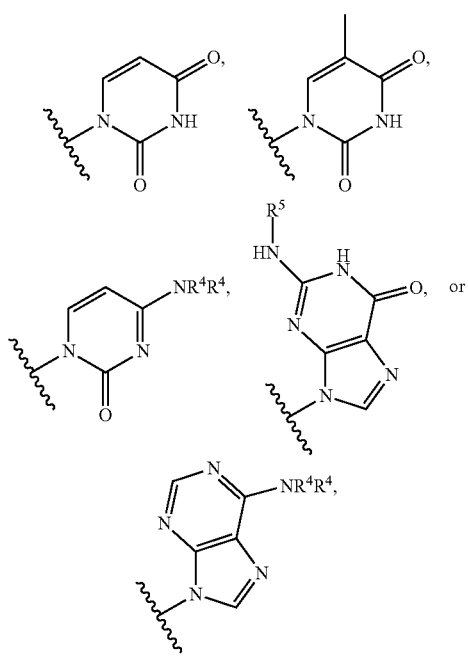

X is O, NH, or C(=O), $L^1$ and $L^2$ are each independently absent or a linking moiety selected from a phosphodiester, amide and ester linkage, $R^1$ is hydrogen, deuterium, halogen, substituted or unsubstituted $C_1$-$C_{10}$ alkyl, substituted or unsubstituted $C_2$-$C_{10}$ alkenyl, substituted or unsubstituted $C_2$-$C_{10}$ alkynyl, substituted or unsubstituted $C_1$-$C_{10}$ fluoroalkyl, substituted or unsubstituted $C_1$-$C_{20}$ heteroalkyl, substituted or unsubstituted cycloalkyl, substituted or unsubstituted heterocycloalkyl, substituted or unsubstituted aryl, substituted or unsubstituted heteroaryl, substituted or unsubstituted —O-aryl, —$OR^6$, —C(=O)$R^6$, —C(=O)$OR^6$, —C(=O)$NR^7R^7$, —$OCH_2$C(=O)$R^6$, —$OCH_2$C(=O)$OR^6$, or —$OCH_2$C(=O)$NR^7R^7$, each $R^2$ is independently hydrogen, deuterium, or substituted or unsubstituted $C_1$-$C_{10}$ alkyl, or two $R^2$ are taken together with the nitrogen atom to which they are attached to form a substituted or unsubstituted $C_3$-$C_{10}$ heterocycloalkyl, $R^3$ is hydrogen, 4,4'-dimethoxytrityl (DMT), —$R^6$, —$OR^6$, or —$NR^7R^7$, each $R^4$ is independently hydrogen, substituted or unsubstituted $C_1$-$C_6$alkyl, substituted or unsubstituted aryl, or substituted or unsubstituted benzoyl, $R^5$ is —C(=O)$OR^6$, and each $R^6$ and $R^7$ are independently hydrogen, substituted or unsubstituted $C_1$-$C_6$alkyl, substituted or unsubstituted $C_1$-$C_6$fluoroalkyl, substituted or unsubstituted $C_3$-$C_6$cycloalkyl, substituted or unsubstituted heterocycloalkyl, substituted or unsubstituted aryl, or substituted or unsubstituted heteroaryl. In some embodiments, a compound derived from a formula (e.g., a derivative compound from Formula II-3) comprises a modified form of the formula with a substituted group. For example, in one embodiment, a compound derived from Formula II-3 has a phosphodiester group, phosphotriester group or a phosphorothioate group substituting phosphonamidite group.

In some embodiments, the oligonucleotide is an RNA oligonucleotide. In some embodiments, the oligonucleotide comprises at least one modification, or at least one 2' modified nucleotide, which is selected from 2'-O-methyl, 2'-O-methoxyethyl (2'-O-MOE), 2'-O-aminopropyl, 2'-deoxy, 2'-deoxy-2'-fluoro, 2'-O-aminopropyl (2'-O-AP), 2'—O-dimethylaminoethyl (2'-O-DMAOE), 2'-O-dimethylaminopropyl (2'-O-DMAP), 2'-O-dimethylaminoethyloxyethyl (2'-O-DMAEOE), or 2'-O—N-methylacetamido (2'-O-NMA) modified nucleotide, or alternatively selected from locked nucleic acid (LNA) or ethylene nucleic acid (ENA). Alternatively and/or additionally, the oligonucleotide comprises at least one modified internucleotide linkage, optionally selected from a phosphorothioate, a phosphorodithioate, a methylphosphonate, a phosphotriester, or an amide linkage.

In some embodiments, the derivative compound of Formula (II-3) is located at the 5'-terminus of the oligonucleotide. Alternatively and/or additionally, the compound of Formula (II-2) is located at the 3'-terminus of the oligonucleotide. Alternatively and/or additionally, the derivative compound of Formula (II-3) is located at the 5'-terminus of the oligonucleotide; and the binding moiety is conjugated to the 3'-terminus of the oligonucleotide. Alternatively and/or additionally, the compound of Formula (II-1) is located at an internal position within the oligonucleotide. Alternatively and/or additionally, the compound of Formula (II-2) is located at the 5'-terminus of the oligonucleotide; and the binding moiety is conjugated to the 3'-terminus of the oligonucleotide. Alternatively and/or additionally, the compound of Formula (II-2) is located at the 3'-terminus of the oligonucleotide, and the binding moiety is conjugated to the 5'-terminus of the oligonucleotide. Alternatively and/or additionally, the compound of Formula (II-1) is located in the interior of the of the oligonucleotide, and the binding moiety is conjugated to the 5'-terminus or the 3'-terminus of the oligonucleotide. In some embodiments, Formula (I) further comprises C to form A-B-C (Formula I-A), wherein A and C are not attached to B at the same terminus. In some embodiments, C is a polymer, which can comprise polyethylene glycol.

In some embodiments, the binding moiety comprises an antibody or a binding fragment thereof. In some embodiments, the binding moiety comprises a humanized antibody or binding fragment thereof, a chimeric antibody or binding fragment thereof, a monoclonal antibody or binding fragment thereof, a monovalent Fab', a divalent Fab2, a single-chain variable fragment (scFv), a diabody, a minibody, a nanobody, a single-domain antibody (sdAb), or a camelid antibody or binding fragment thereof. In some embodiments, the binding moiety comprises a peptide or a small molecule.

In some embodiments, the oligonucleotide comprises from about 8 to about 50 nucleotides, or from about 10 to about 30 nucleotides.

In some embodiments, B of Formula I comprises an RNA oligonucleotide, has a length from about 10 to about 30 nucleotides, comprises at least one 2' modified nucleotide, and comprises at least one modified internucleotide linkage. In some embodiments, B hybridizes to at least 8 contiguous bases of a target gene sequence. In some embodiments, B mediates RNA interference. In some embodiments, B is a sense strand. In some embodiments, B is hybridized with a second oligonucleotide to form a double-stranded oligonucleic acid molecule. In some embodiments, the second oligonucleotide is an antisense strand. In some embodiments, the second oligonucleotide is an RNA oligonucleotide. In some embodiments, the second oligonucleotide comprises at least one modification. In some embodiments, the second oligonucleotide comprises a compound of Formula (II) or a compound of Formula (IIa). In some embodiments, the second oligonucleotide comprises at least one 2' modified nucleotide. In some embodiments, the second oligonucleotide comprises at least one 2' modified nucleotide selected from 2'-O-methyl, 2'-O-methoxyethyl (2'-O-MOE), 2'-O-aminopropyl, 2'-deoxy, 2'-deoxy-2'-fluoro, 2'-O-aminopropyl (2'-O-AP), 2'-O-dimethylaminoethyl (2'-O-DMAOE), 2'-O-dimethylaminopropyl (2'-O-DMAP), 2'-O— dimethylaminoethyloxyethyl (2'-O-DMAEOE), or 2'-O—N-methylacetamido (2'-O-NMA) modified nucleotide, or alternatively and/or additionally selected from locked nucleic acid (LNA) or ethylene nucleic acid (ENA).

In some embodiments, the second oligonucleotide comprises at least one modified internucleotide linkage. In some embodiments, the second oligonucleotide comprises at least one, or at least three modified internucleotide linkage selected from a phosphorothioate linkage or a phosphorodithioate linkage.

In some embodiments, the oligonucleotide is a sense strand, is an RNA oligonucleotide, is conjugated to a binding moiety, a polymer, or a combination thereof, is from about 10 to about 30 nucleotides, comprises at least one 2' modified nucleotide, and comprises at least one modified internucleotide linkage.

In some embodiments, also described herein include methods for treating a disease or condition (e.g., cancer) that utilize a composition or a pharmaceutical formulation comprising a binding moiety conjugated to a polynucleic acid molecule and optionally a polymer. Thus, disclosed herein includes a method of treating a subject having a disease or condition characterized with a defective protein expression, comprising administering to the subject an oligonucleotide conjugate described herein to modulate expression of a gene encoding the protein, thereby treating the disease or condition characterized with the defective protein expression. Also disclosed herein includes a method of treating a subject having a disease or condition characterized with an overexpressed protein expression, comprising administering to the subject an oligonucleotide conjugate as described herein to modulate expression of a gene encoding the protein, thereby treating the disease or condition characterized with the overexpressed protein expression. In some embodiments, the disease or condition is a cancer, a neuromuscular disease, a muscle dystrophy, a muscle atrophy, a muscle wasting, a genetic disease, a hereditary disease, or a cardiovascular disease.

Disclosed herein, in certain embodiments, is a method of inhibiting the expression of a target gene in a primary cell of a patient, comprising administering a molecule described above to the primary cell. In some embodiments, the method is an in vivo method. In some embodiments, the patient is a human.

Disclosed herein, in certain embodiments, is an immuno-oncology therapy comprising a molecule described above for the treatment of a disease or disorder in a patient in need thereof.

Disclosed herein, in certain embodiments, is a kit comprising a molecule described above.

BRIEF DESCRIPTION OF THE DRAWINGS

The following drawings form part of the present specification and are included to further demonstrate certain aspects of the present disclosure. The disclosure may be better understood by reference to one or more of these drawings in combination with the detailed description of specific embodiments presented herein.

DETAILED DESCRIPTION

Figure 1A:
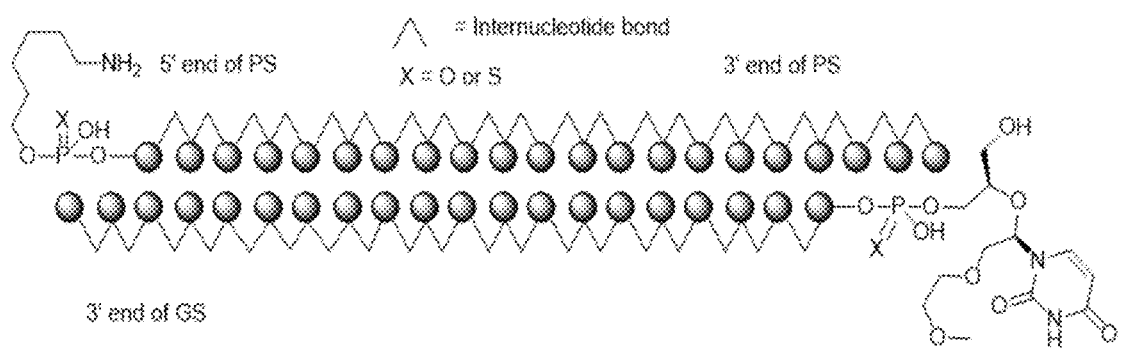
FIG. 1A shows a cartoon representation of a polynucleotide duplex, comprising a compound of Formula (II) attached to the 5' end of the guide (antisense) strand, and further comprising a binding moiety A, which may be attached to the polynucleotide directly or via a linker, attached to the: 5' end of the passenger (sense) strand.
Figure 1B:
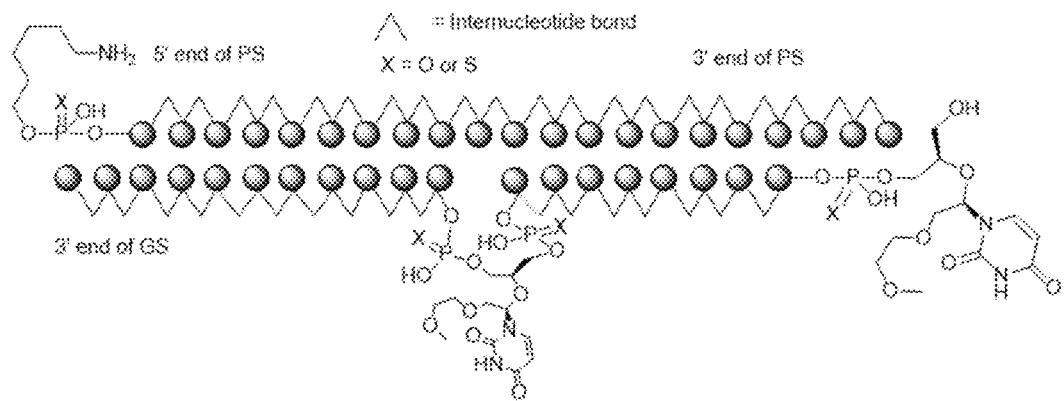
FIG. 1B shows a cartoon representation of a polynucleotide duplex, comprising one or more compounds of Formula (II) attached to the 5' end of the guide (antisense) strand, and inserted into the antisense strand, and further comprising a binding moiety A, which may be attached to the polynucleotide directly or via a linker, attached to the: 5' end of the passenger (sense) strand.
Figure 2:
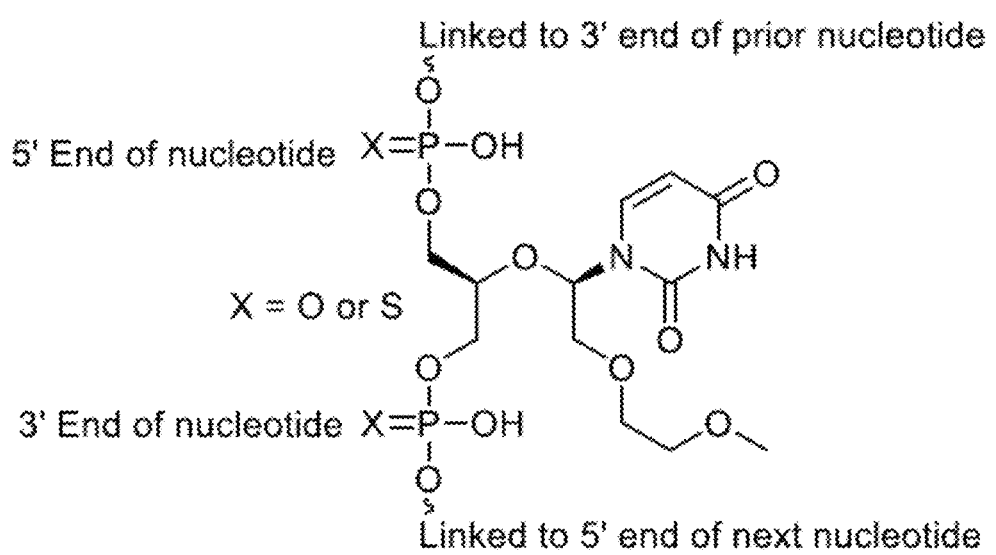
FIG. 2 shows a cartoon representation of an exemplary compound of Formula (II) in an oligonucleotide.

Nucleic acid (e.g., RNAi) therapy is a targeted therapy with high selectivity and specificity. However, in some instances, nucleic acid therapy is also hindered by poor intracellular uptake, limited blood stability and non-specific immune stimulation. To address these issues, various modifications of the nucleic acid composition are explored, such as for example, novel linkers for better stabilizing and/or lower toxicity, optimization of binding moiety for increased target specificity and/or target delivery, and nucleic acid polymer modifications for increased stability and/or reduced off-target effect.

In some embodiments, the arrangement or order of the different components that make-up the nucleic acid composition further effects intracellular uptake, stability, toxicity, efficacy, and/or non-specific immune stimulation. For example, if the nucleic acid component includes a binding moiety, a polymer, and a polynucleic acid molecule (or polynucleotide), the order or arrangement of the binding moiety, the polymer, and/or the polynucleic acid molecule (or polynucleotide) (e.g., binding moiety-polynucleic acid molecule-polymer, binding moiety-polymer-polynucleic acid molecule, or polymer-binding moiety-polynucleic acid molecule) further effects intracellular uptake, stability, toxicity, efficacy, and/or non-specific immune stimulation.

In some embodiments, described herein include an oligonucleotide conjugate whose arrangement of the nucleic acid components effects intracellular uptake, stability, toxicity, efficacy, and/or non-specific immune stimulation. In some instances, the oligonucleotide conjugate comprises a binding moiety conjugated to a polynucleic acid molecule and a polymer. In some embodiments, the oligonucleotide conjugate comprises a compound according to Formula (II) or Formula (IIa):

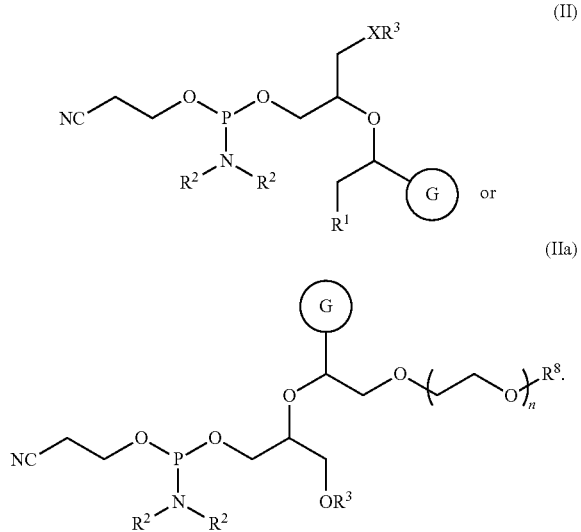

In some embodiments, an oligonucleotide conjugate comprising a binding moiety conjugated to a polynucleic acid molecule and a polymer arranged as described herein enhances intracellular uptake, stability, and/or efficacy. In some instances, an oligonucleotide conjugate comprising a binding moiety conjugated to a polynucleic acid molecule and a polymer arranged as described herein reduces toxicity and/or non-specific immune stimulation. In some cases, the oligonucleotide conjugate comprises a compound according to Formula (II) or Formula (IIa):

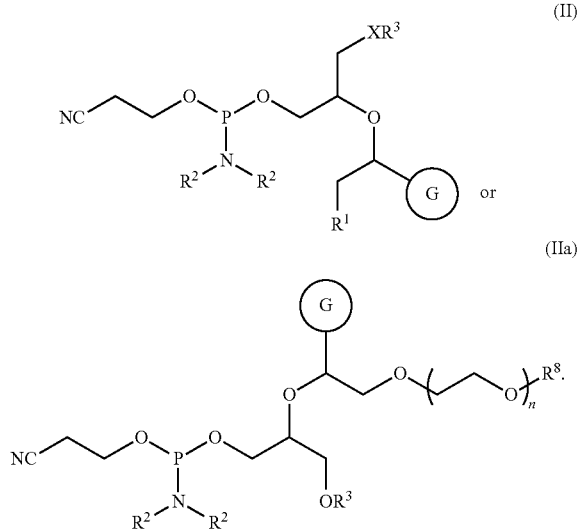

In additional embodiments, described herein include a kit, which comprises one or more of the molecules or compositions described herein.

Therapeutic Molecule Platform

In some embodiments, an oligonucleotide conjugate (e.g., a therapeutic oligonucleotide conjugate) described herein comprises a binding moiety conjugated to a polynucleic acid molecule comprising one or more modified nucleotides and a polymer. In some embodiments, the oligonucleotide conjugate comprises a compound according to Formula (I) or Formula (I-A):

A-B        Formula (I);

wherein,
A is a binding moiety; and
B is an oligonucleotide comprising a compound of Formula (II) or (IIa)

A-B-C      Formula (I-A);

wherein,
A is a binding moiety; and
B is an oligonucleotide comprising a compound of Formula (II) or (IIa)
C is optionally a polymer.

In some embodiments, the oligonucleotide comprises a compound according to Formula (II):

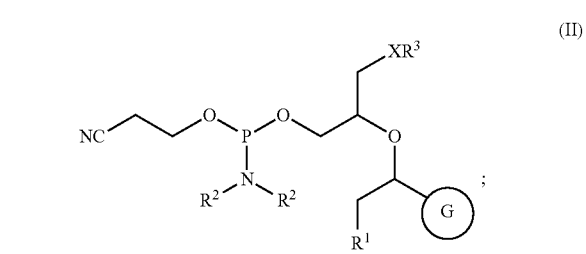

wherein, Ring G is

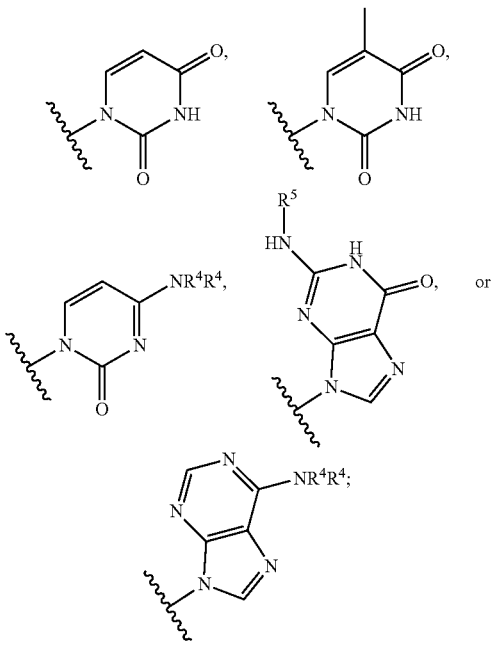

X is O, NH, or C(=O);
$R^1$ is hydrogen, deuterium, halogen, substituted or unsubstituted $C_1$-$C_{10}$ alkyl, substituted or unsubstituted C$_2$-C$_{10}$ alkenyl, substituted or unsubstituted C$_2$-C$_{10}$ alkynyl, substituted or unsubstituted C$_1$-C$_{10}$ fluoroalkyl, substituted or unsubstituted C$_1$-C$_{20}$ heteroalkyl, substituted or unsubstituted cycloalkyl, substituted or unsubstituted heterocycloalkyl, substituted or unsubstituted aryl, substituted or unsubstituted heteroaryl, substituted or unsubstituted —O-aryl, —OR$^6$, —C(=O)R$^6$, —C(=O)OR$^6$, —C(=O)NR$^7$R$^7$, —OCH$_2$C(=O)R$^6$, —OCH$_2$C(=O)OR$^6$, or —OCH$_2$C(=O)NR$^7$R$^7$;

each R$^2$ is independently hydrogen, deuterium, or substituted or unsubstituted C$_1$-C$_{10}$ alkyl;

or two R$^2$ are taken together with the nitrogen atom to which they are attached to form a substituted or unsubstituted C$_3$-C$_{10}$ heterocycloalkyl;

R$^3$ is hydrogen, 4,4'-dimethoxytrityl (DMT), —R$^6$, —OR$^6$, or —NR$^7$R$^7$;

each R$^4$ is independently hydrogen, substituted or unsubstituted C$_1$-C$_6$alkyl, substituted or unsubstituted aryl, or substituted or unsubstituted benzoyl;

R$^5$ is —C(=O)R$^6$;

each R$^6$ and R$^7$ are independently hydrogen, substituted or unsubstituted C$_1$-C$_6$alkyl, substituted or unsubstituted C$_1$-C$_6$fluoroalkyl, substituted or unsubstituted C$_3$-C$_6$cycloalkyl, substituted or unsubstituted heterocycloalkyl, substituted or unsubstituted aryl, or substituted or unsubstituted heteroaryl.

In some embodiments of Formula (II), R$^1$ is halogen, substituted or unsubstituted C$_1$-C$_{10}$ alkyl, substituted or unsubstituted C$_1$-C$_{10}$ fluoroalkyl, substituted or unsubstituted C$_1$-C$_{20}$ heteroalkyl, substituted or unsubstituted aryl, substituted or unsubstituted heteroaryl, substituted or unsubstituted cycloalkyl, or substituted or unsubstituted heterocycloalkyl, substituted or unsubstituted —O-aryl, —OH, —OR$^6$, —C(=O)R$^6$, —C(=O)OR$^6$, —C(=O)NR$^7$R$^7$, —OCH$_2$C(=O)R$^6$, or —OCH$_2$C(=O)OR$^6$, or —OCH$_2$C(=O)NR$^7$R$^7$.

In some embodiments of Formula (II), R$^5$ is halogen, substituted or unsubstituted C$_1$-C$_{10}$ alkyl, substituted or unsubstituted C$_1$-C$_{20}$ heteroalkyl, substituted or unsubstituted —O-aryl, —OCH$_2$C(=O)R$^6$, or —OCH$_2$C(=O)OR$^6$, or —OCH$_2$C(=O)NR$^7$R$^7$. In some embodiments of Formula (II), R$^1$ is halogen or substituted or unsubstituted C$_1$-C$_{20}$ heteroalkyl. In some embodiments of Formula (II), R$^1$ is fluoro, choro, or bromo. In some embodiments of Formula (II), R$^1$ is fluoro.

In some embodiments of Formula (II), R$^1$ is

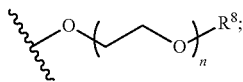

n is 0, 1, 2, 3, 4, or 5; and R$^8$ is hydrogen or substituted or unsubstituted C$_1$-C$_3$ alkyl. In some embodiments, n is 1, 2, or 3. In some embodiments, n is 1 or 2. In some embodiments, n is 1. In some embodiments, n is 2. In some embodiments, n is 0.

In some embodiments of Formula (II), R$^1$ is

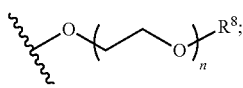

and R$^8$ is substituted or unsubstituted C$_1$-C$_3$ alkyl. In some embodiments, R$^8$ is methyl or ethyl. In some embodiments, R$^8$ is methyl. In some embodiments, R$^8$ is ethyl. In some embodiments, R$^8$ is H.

In some embodiments of Formula (II), Ring G is

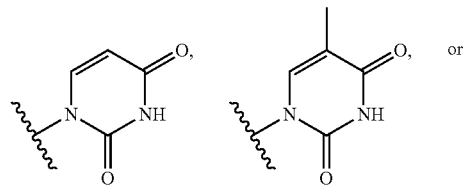

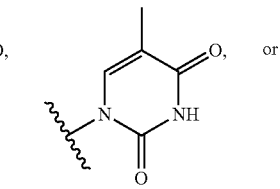

wherein each R$^4$ is independently hydrogen or substituted or unsubstituted benzoyl. In some embodiments of Formula (II), ring B is

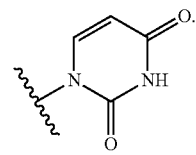

In some embodiments of Formula (II), Ring G is

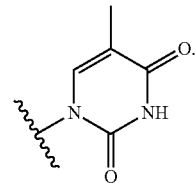

In some embodiments of Formula (II), Ring G is

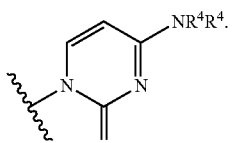

In some embodiments of Formula (II), Ring G is,

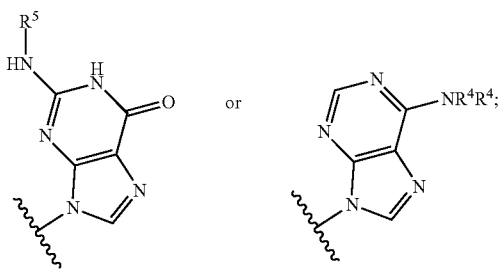

wherein each R⁴ is independently hydrogen or substituted or unsubstituted benzoyl; and R⁵ is —C(=O)R⁶. In some embodiments of Formula (II), Ring G is,

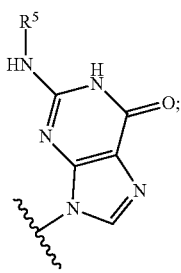

wherein R⁵ is —C(=O)R⁶. In some embodiments of Formula (II), Ring G is

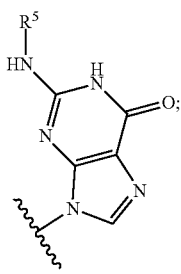

wherein R⁵ is —C(=O)CH(CH₃)₂. In some embodiments of Formula (II), Ring G is

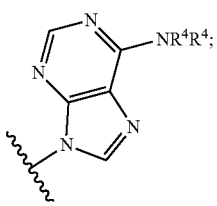

wherein each R⁴ is independently hydrogen or substituted or unsubstituted benzoyl.

In some embodiments of Formula (II), each R² is independently hydrogen, deuterium, or substituted or unsubstituted C₁-C₁₀ alkyl. In some embodiments of Formula (II), each R² is independently substituted or unsubstituted C₁-C₁₀ alkyl. In some embodiments of Formula (II), each R² is isopropyl.

In some embodiments of Formula (II), two R² are taken together with the nitrogen atom to which they are attached to form a substituted or unsubstituted C₃-C₁₀ heterocycloalkyl.

In some embodiments of Formula (II), X is O and R³ is 4,4'-dimethoxytrityl (DMT).

In some embodiments, the oligonucleotide comprises a compound according to Formula (IIa):

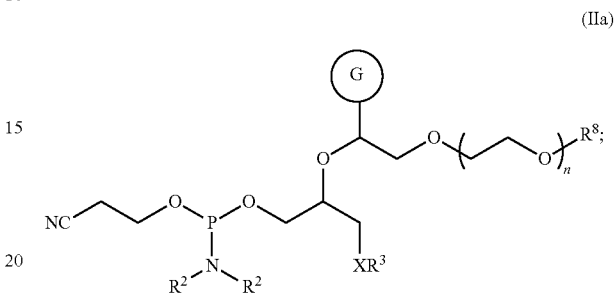

(IIa)

wherein: Ring G is

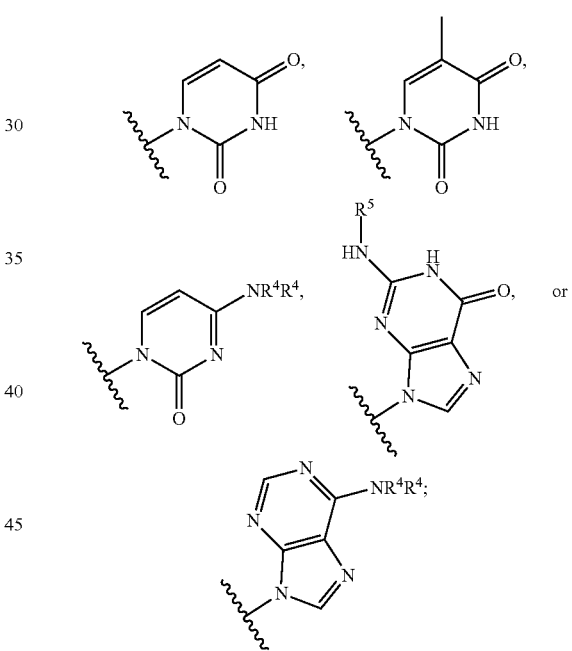

X is O, NH, or C(=O);
n is 0, 1, 2, 3, or 4;
R⁸ is substituted or unsubstituted C₁-C₆ alkyl;
each R² is independently hydrogen, deuterium, or substituted or unsubstituted C₁-C₁₀ alkyl;
or two R² are taken together with the nitrogen atom to which they are attached to form a substituted or unsubstituted C₃-C₁₀cycloalkyl;
R³ is hydrogen, 4,4'-dimethoxytrityl (DMT), —R⁶, —OR⁶, or —NR⁷R⁷.
each R⁴ is independently hydrogen, substituted or unsubstituted C₁-C₆alkyl, substituted or unsubstituted aryl, or substituted or unsubstituted benzoyl;
R⁵ is —C(=O)R⁶;
each R⁶ and R⁷ are independently hydrogen, substituted or unsubstituted C₁-C₆alkyl, substituted or unsubstituted $C_1$-$C_6$fluoroalkyl, substituted or unsubstituted $C_3$-$C_6$cycloalkyl, substituted or unsubstituted heterocycloalkyl, substituted or unsubstituted aryl, or substituted or unsubstituted heteroaryl.

In some embodiments of Formula (IIa), Ring G is

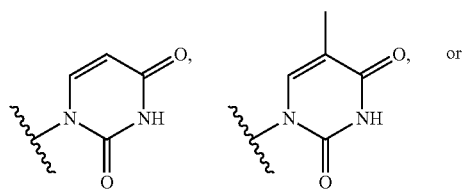

In some embodiments of Formula (IIa), Ring G is

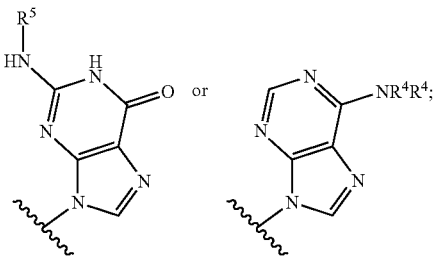

wherein each $R^4$ is independently hydrogen or substituted or unsubstituted benzyl; and $R^5$ is —C(=O)$R^6$. In some embodiments of Formula (IIa), Ring G is

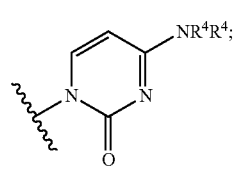

NR$^4$R$^4$ wherein each $R^4$ is independently hydrogen or substituted or unsubstituted benzyl. In some embodiments of Formula (IIa), Ring G is

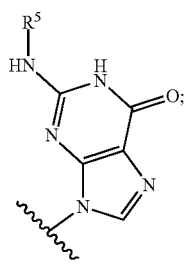

wherein $R^5$ is —C(=O)$R^6$. In some embodiments of Formula (IIa), Ring G is

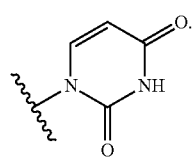 [SMILES: *n1ccc(=O)[nH]c1=O]

In some embodiments of Formula (II), Ring G is

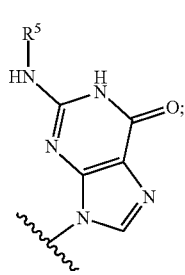

wherein $R^5$ is —C(=O)CH(CH$_3$)$_2$. In some embodiments of Formula (IIa), Ring G is

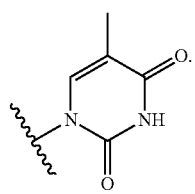 [SMILES: *n1cc(C)c(=O)[nH]c1=O]

In some embodiments of Formula (IIa), Ring G is

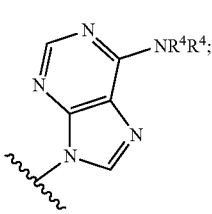

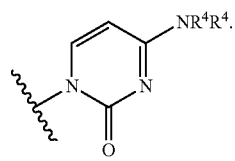

wherein each $R^4$ is independently hydrogen or substituted or unsubstituted benzoyl.

In some embodiments of Formula (IIa), n is 0, 1, 2, 3, 4, or 5. In some embodiments of Formula (IIa), n is 0, 1, 2, 3, or 4. In some embodiments of Formula (IIa), n is 1 or 2. In some embodiments of Formula (IIa), n is 0. In some embodiments of Formula (IIa), n is 1. In some embodiments of Formula (IIa), n is 2.

In some embodiments of Formula (IIa), $R^8$ is hydrogen or substituted or unsubstituted $C_1$-$C_3$ alkyl. In some embodiments of Formula (IIa), $R^8$ is substituted or unsubstituted $C_1$-$C_3$ alkyl. In some embodiments of Formula (IIa), $R^8$ is methyl or ethyl. In some embodiments of Formula (IIa), $R^8$ is methyl.

In some embodiments of Formula (IIa), each $R^2$ is independently hydrogen, deuterium, or substituted or unsubstituted $C_1$-$C_{10}$ alkyl. In some embodiments of Formula (IIa), each $R^2$ is independently substituted or unsubstituted $C_1$-$C_{10}$ alkyl. In some embodiments of Formula (IIa), each $R^2$ is isopropyl.

In some embodiments of Formula (IIa), two $R^2$ are taken together with the nitrogen atom to which they are attached to form a substituted or unsubstituted $C_3$-$C_{10}$ heterocycloalkyl.

In some embodiments of Formula (IIa), $R^3$ is 4,4'-dimethoxytrityl (DMT).

In some embodiments of Formula (II) or (IIa), the compound is selected from the group consisting of:

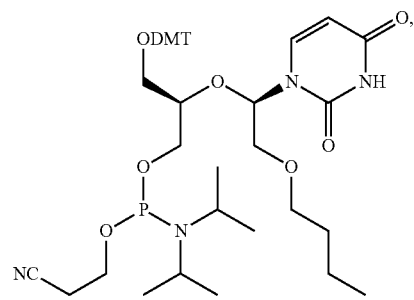

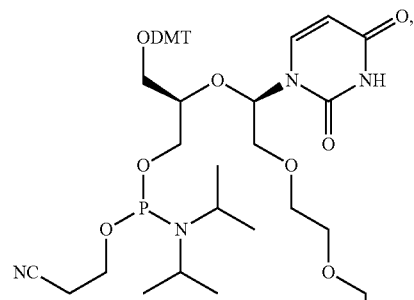

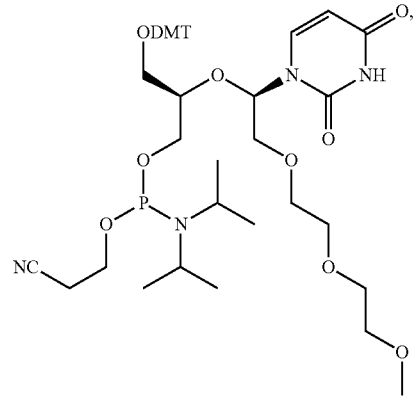

-continued

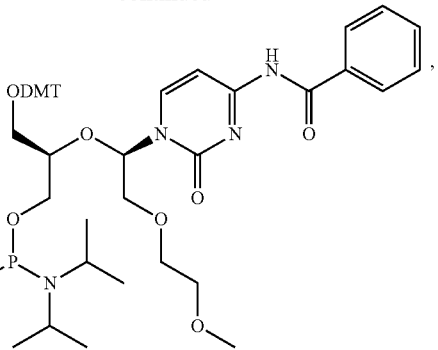

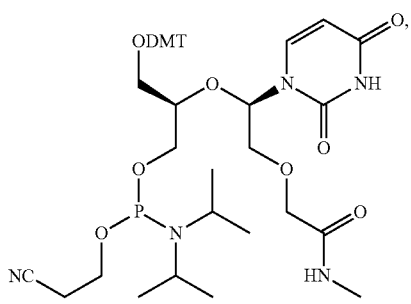

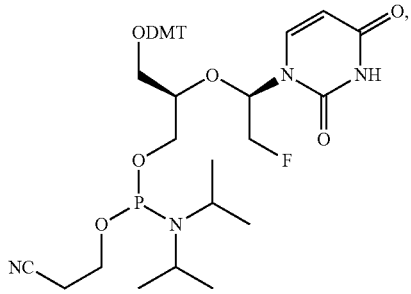

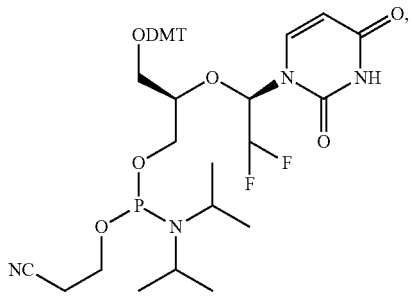

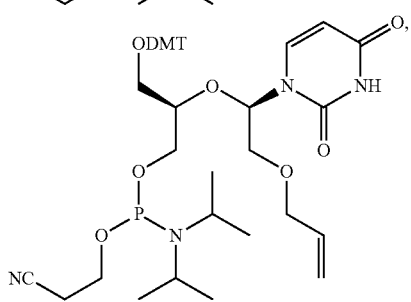

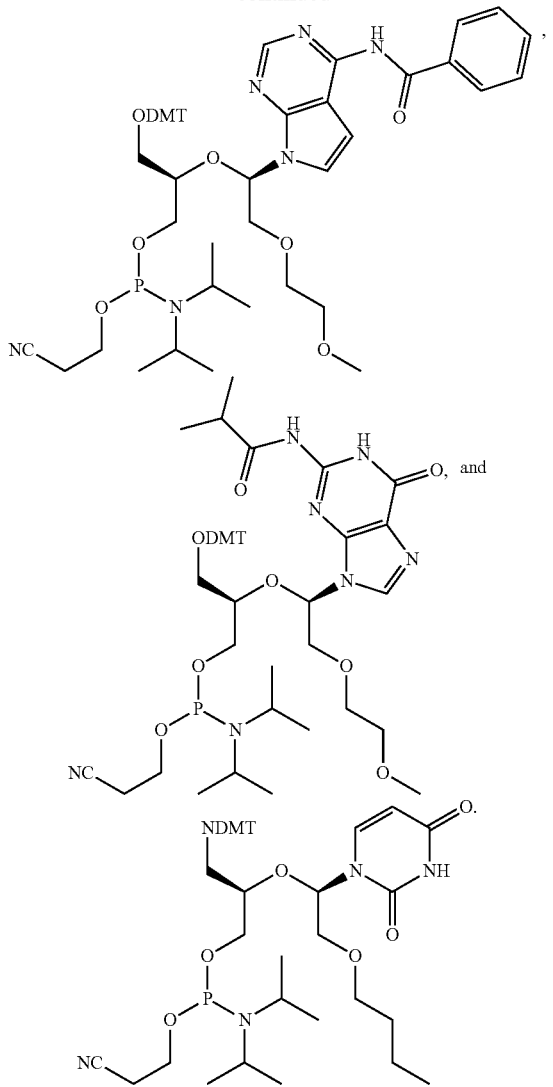

In some embodiments, the oligonucleotide comprises at least about 1, about 2, about 3, about 4, about 5, about 6, about 7, about 8, about 9, about 10, about 11, about 12, about 13, about 14, about 15, about 16, about 17, about 18, about 19, about 20, about 21, about 22, about 23, about 24, about 25, about 30, or more compounds of Formula (II) (e.g., Formula IIa). In some cases, the oligonucleotide comprises at least about 1, about 2, about 3, about 4, about 5, about 6, about 7, about 8, about 9, about 10, about 11, about 12, about 13, about 14, about 15, or more compounds of Formula (II) (e.g., Formula IIa). In some instances, the compounds of Formula (II) (e.g., Formula IIa) are in tandem within the oligonucleotide. In other instances, the compounds Formula (II) (e.g., Formula IIa) are interspersed within the oligonucleotide, with nucleotides modified by one or more additional modification described below.

In some instances, the oligonucleotide comprises at least one of: from about 5% to about 100% modification, from about 10% to about 100% modification, from about 20% to about 100% modification, from about 30% to about 100% modification, from about 40% to about 100% modification, from about 50% to about 100% modification, from about 60% to about 100% modification, from about 70% to about 100% modification, from about 80% to about 100% modification, and from about 90% to about 100% modification, in which the modification is a compound of Formula (II) (e.g., Formula IIa). For example, where the oligonucleotide has 20 nucleosides, the oligonucleotide having about 60% modification comprises about 12 nucleosides substituted with 12 Formula (II) (e.g., Formula IIa) compounds.

Figure 5A:
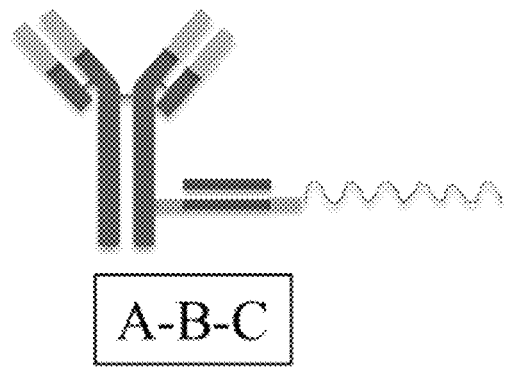
FIG. 5A illustrates an example embodiment of an oligonucleotide conjugate molecule.

In some embodiments, an oligonucleotide conjugate is a molecule as shown in FIG. 5A.

Figure 5B:
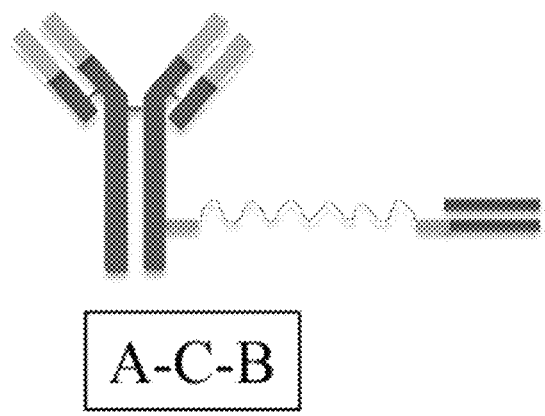
FIG. 5B illustrates an additional example embodiment of an oligonucleotide conjugate molecule.

In some embodiments, an oligonucleotide conjugate is a molecule as shown in FIG. 5B.

Figure 5C:
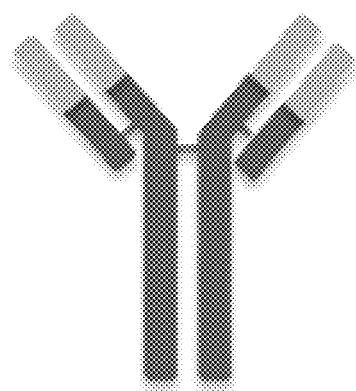
FIG. 5C illustrates an exemplary diagram of antibody or binding fragment thereof.

The diagram as illustrated in FIG. 5C is for representation purposes only and encompasses a humanized antibody or binding fragment thereof, chimeric antibody or binding fragment thereof, anti-human antibody, anti-murine antibody (e.g., anti-mouse antibody, anti-rat antibody, etc.), monoclonal antibody or binding fragment thereof, monovalent Fab', divalent Fab2, single-chain variable fragment (scFv), diabody, minibody, nanobody, single-domain antibody (sdAb), or camelid antibody or binding fragment thereof.

Additional Modifications

In some embodiments, the additional modifications include synthetic or artificial nucleotide analogues or bases comprising modifications at one or more of ribose moiety, phosphate moiety, nucleoside moiety, or a combination thereof.

In some embodiments, a modification at a 2' hydroxyl group include 2'-deoxy, 2-deoxy-2'-fluoro, 2'-O-aminopropyl (2-O-AP), 2'-O-dimethylaminoethyl (2'-O-DMAOE), 2'-O-dimethylaminopropyl (2'-O-DMAP), 2'-O-dimethylaminoethyloxyethyl (2'-O-DMAEOE), or 2'-O—N-methylacetamido (2'-O-NMA).

In some embodiments, a nucleotide analogue comprises a modified base such as, but not limited to, 5-propynyluridine, 5-propynylcytidine, 6-methyladenine, 6-methylguanine, N, N,-dimethyladenine, 2-propyladenine, 2-propylguanine, 2-aminoadenine, 1-methylinosine, 3-methyluridine, 5-methylcytidine, 5-methyluridine and other nucleotides having a modification at the 5 position, 5-(2-amino) propyl uridine, 5-halocytidine, 5-halouridine, 4-acetylcytidine, 1-methyladenosine, 2-methyladenosine, 3-methylcytidine, 6-methyluridine, 2-methylguanosine, 7-methylguanosine, 2, 2-dimethylguanosine, 5-methylaminoethyluridine, 5-methyloxyuridine, deazanucleotides (such as 7-deaza-adenosine, 6-azouridine, 6-azocytidine, or 6-azothymidine), 5-methyl-2-thiouridine, other thio bases (such as 2-thiouridine, 4-thiouridine, and 2-thiocytidine), dihydrouridine, pseudouridine, queuosine, archaeosine, naphthyl and substituted naphthyl groups, any O- and N-alkylated purines and pyrimidines (such as N6-methyladenosine, 5-methylcarbonylmethyluridine, uridine 5-oxyacetic acid, pyridine-4-one, or pyridine-2-one), phenyl and modified phenyl groups such as aminophenol or 2,4,6-trimethoxy benzene, modified cytosines that act as G-clamp nucleotides, 8-substituted adenines and guanines, 5-substituted uracils and thymines, azapyrimidines, carboxyhydroxyalkyl nucleotides, carboxyalkylaminoalkyi nucleotides, and alkylcarbonylalkylated nucleotides. 5'-modified nucleotides also include those nucleotides that are modified with respect to the sugar moiety, as well as 5'-modified nucleotides having sugars or analogs thereof that are not ribosyl. For example, the sugar moieties, in some cases are or are based on, mannoses, arabinoses, glucopyranoses, galactopyranoses, 4'-thioribose, and other sugars, heterocycles, or carbocycles. The term nucleotide also includes what are known in the art as universal bases. By way of example, universal bases include but are not limited to 3-nitropyrrole, 5-nitroindole, or nebularine.

In some instances, the modification at the 2' hydroxyl group is a 2'-O-aminopropyl modification in which an extended amine group comprising a propyl linker binds the amine group to the 2' oxygen. In some instances, this modification neutralizes the phosphate-derived overall negative charge of the oligonucleotide molecule by introducing one positive charge from the amine group per sugar and thereby improves cellular uptake properties due to its zwitterionic properties.

In some instances, the 5'-modified nucleotide is further modified at the 2' hydroxyl group in a locked or bridged ribose modification (e.g., locked nucleic acid or LNA) in which the oxygen molecule bound at the 2' carbon is linked to the 4' carbon by a methylene group, thus forming a 2'-C,4'-C-oxy-methylene-linked bicyclic ribonucleotide monomer.

In some embodiments, the additional modification further comprises a morpholino, a peptide nucleic acid (PNA), a methylphosphonate nucleotide, a thiolphosphonate nucleotide, a 2'-fluoro N3-P5'-phosphoramidite, or a 1', 5'-anhydrohexitol nucleic acid (HNA). Morpholino or phosphorodiamidate morpholino oligo (PMO) comprises synthetic molecules whose structure mimics natural nucleic acid structure but deviates from the normal sugar and phosphate structures. In some instances, the five member ribose ring is substituted with a six member morpholino ring containing four carbons, one nitrogen, and one oxygen. In some cases, the ribose monomers are linked by a phosphordiamidate group instead of a phosphate group. In such cases, the backbone alterations remove all positive and negative charges making morpholinos neutral molecules capable of crossing cellular membranes without the aid of cellular delivery agents such as those used by charged oligonucleotides. A non-limiting example of a 5'-modified morpholino oligonucleotide is illustrated below.

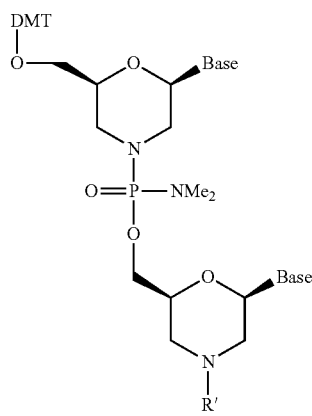

Morpholino

In some embodiments, a 5'-modified morpholino or PMO described above is a PMO comprising a positive or cationic charge. In some instances, the PMO is PMOplus (Sarepta). PMOplus refers to phosphorodiamidate morpholino oligomers comprising any number of (1-piperazino)phosphinylideneoxy, (1-(4-(omega-guanidino-alkanoyl))-piperazino) phosphinylideneoxy linkages (e.g., as such those described in PCT Publication No. WO2008/036127. In some cases, the PMO is a PMO described in U.S. Pat. No. 7,943,762.

In some embodiments, a morpholino or PMO described above is a PMO-X (Sarepta). In some cases, PMO-X refers to phosphorodiamidate morpholino oligomers comprising at least one linkage or at least one of the disclosed terminal modifications, such as those disclosed in PCT Publication No. WO2011/150408 and U.S. Publication No. 2012/0065169.

In some embodiments, a morpholino or PMO described above is a PMO as described in Table 5 of U.S. Publication No. 2014/0296321.

In some embodiments, peptide nucleic acid (PNA) does not contain sugar ring or phosphate linkage and the bases are attached and appropriately spaced by oligoglycine-like molecules, therefore, eliminating a backbone charge.

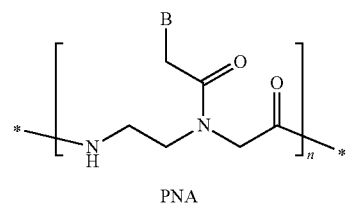

PNA

In some embodiments, one or more modifications described above occur at the internucleotide linkage. In some instances, modified internucleotide linkage includes, but is not limited to, phosphorothioates; phosphorodithioates; methylphosphonates; 5'-alkylenephosphonates; 5'-methylphosphonate; 3'-alkylene phosphonates; borontrifluoridates; borano phosphate esters and selenophosphates of 3'-5'linkage or 2'-5'linkage; phosphotriesters; thionoalkylphosphotriesters; hydrogen phosphonate linkages; alkyl phosphonates; alkylphosphonothioates; arylphosphonothioates; phosphoroselenoates; phosphorodiselenoates; phosphinates; phosphoramidates; 3'-alkylphosphoramidates; aminoalkylphosphoramidates; thionophosphoramidates; phosphoropiperazidates; phosphoroanilothioates; phosphoroanilidates; ketones; sulfones; sulfonamides; carbonates; carbamates; methylenehydrazos; methylenedimethylhydrazos; formacetals; thioformacetals; oximes; methyleneiminos; methylenemethyliminos; thioamidates; linkages with riboacetyl groups; aminoethyl glycine; silyl or siloxane linkages; alkyl or cycloalkyl linkages with or without heteroatoms of, for example, 1 to 10 carbons that are saturated or unsaturated and/or substituted and/or contain heteroatoms; linkages with morpholino structures, amides, or polyamides wherein the bases are attached to the aza nitrogens of the backbone directly or indirectly; and combinations thereof.

In some instances, the modification is a methyl or thiol modification such as methylphosphonate or thiolphosphonate modification. Exemplary thiolphosphonate nucleotide (left), phosphorodithioates (center) and methylphosphonate nucleotide (right) are illustrated below.

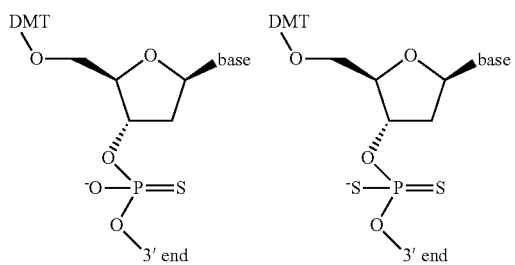

-continued

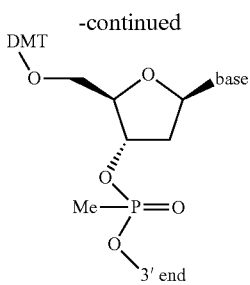

In some instances, a 5'-modified nucleotide includes, but is not limited to, phosphoramidites illustrated as:

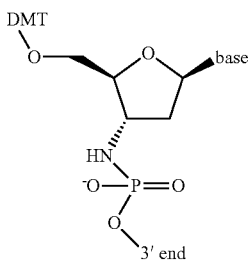

In some instances, the modified internucleotide linkage is a phosphorodiamidate linkage. A non-limiting example of a phosphorodiamidate linkage with a morpholino system is shown below.

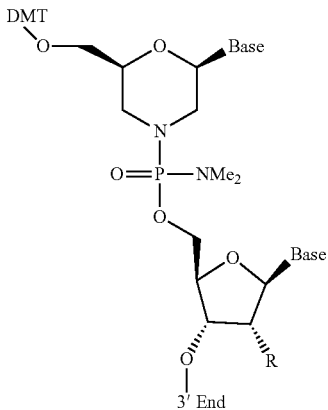

In some instances, the modified internucleotide linkage is a methylphosphonate linkage. A non-limiting example of a methylphosphonate linkage is shown below.

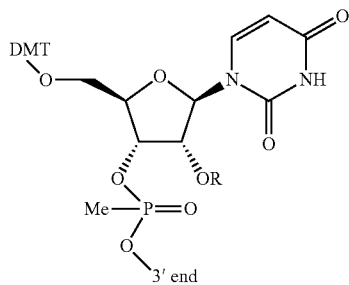

In some instances, the modified internucleotide linkage is an amide linkage. A non-limiting example of an amide linkage is shown below.

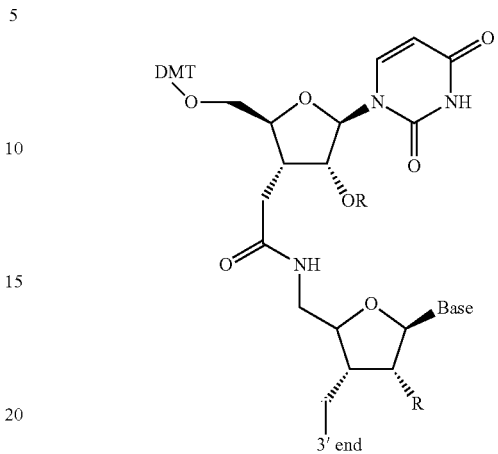

In some embodiments, one or more modifications comprise a modified phosphate backbone in which the modification generates a neutral or uncharged backbone. In some instances, the phosphate backbone is modified by alkylation to generate an uncharged or neutral phosphate backbone. As used herein, alkylation includes methylation, ethylation, and propylation. In some cases, an alkyl group, as used herein in the context of alkylation, refers to a linear or branched saturated hydrocarbon group containing from 1 to 6 carbon atoms. In some instances, exemplary alkyl groups include, but are not limited to, methyl, ethyl, n-propyl, isopropyl, n-butyl, isobutyl, sec-butyl, tert-butyl, n-pentyl, isopentyl, neopentyl, hexyl, isohexyl, 1, 1-dimethylbutyl, 2,2-dimethylbutyl, 3.3-dimethylbutyl, and 2-ethylbutyl groups. In some cases, a modified phosphate is a phosphate group as described in U.S. Pat. No. 9,481,905.

In some embodiments, additional modified phosphate backbones comprise methylphosphonate, ethylphosphonate, methylthiophosphonate, or methoxyphosphonate. In some cases, the modified phosphate is methylphosphonate. In some cases, the modified phosphate is ethylphosphonate. In some cases, the modified phosphate is methylthiophosphonate. In some cases, the modified phosphate is methoxyphosphonate.

In some embodiments, one or more modifications further optionally include modifications of the ribose moiety, phosphate backbone and the nucleoside, or modifications of the nucleotide analogues at the 3' or the 5' terminus. For example, the 3' terminus optionally include a 3' cationic group, or by inverting the nucleoside at the 3'-terminus with a 3'-3' linkage. In another alternative, the 3'-terminus is optionally conjugated with an aminoalkyl group, e.g., a 3' C5-aminoalkyl dT. In an additional alternative, the 3'-terminus is optionally conjugated with an abasic site, e.g., with an apurinic or apyrimidinic site.

In some embodiments, the oligonucleotide comprising a compound of Formula (II) (e.g., Formula IIa) further comprises one or more of the artificial nucleotide analogues described herein. In some instances, the oligonucleotide comprising a compound of Formula (II) (e.g., Formula IIa) further comprises one or more, e.g., 1, 2, 3, 4, 5, 6, 7, 8, 9, 10, 11, 12, 13, 14, 15, 16, 17, 18, 20, 25, or more additional modifications such as, but not limited to, 2'-O-methyl, 2'-0-methoxyethyl (2'-O-MOE), 2'-O-aminopropyl, 2'-deoxy, 2'-deoxy-2'-fluoro, 2'-O-aminopropyl (2'-O-AP), 2'-O-dimethylaminoethyl (2'-O-DMAOE), 2'-O-dimethylaminopropyl (2'-O-DMAP), 2'-O-dimethylaminoethyloxyethyl (2'-O-DMAEOE), or 2'-O—N-methylacetamido (2'-O-NMA) modified, LNA, ENA, PNA, HNA, morpholino, methylphosphonate nucleotides, thiolphosphonate nucleotides, 2'-fluoro N3-P5'-phosphoramidites, or a combination thereof. In some instances, the oligonucleotide comprising a compound of Formula (II) (e.g., Formula IIa) further comprises 1, 2, 3, 4, 5, 6, 7, 8, 9, 10, 11, 12, 13, 14, 15, 16, 17, 18, 20, 25, or more of the artificial nucleotide analogues selected from 2'-O-methyl, 2'-O-methoxyethyl (2'-O-MOE), 2'-O-aminopropyl, 2'-deoxy, 2-deoxy-2'-fluoro, 2'-O-aminopropyl (2'-O-AP), 2'-O-dimethylaminoethyl (2'-O-DMAOE), 2'-O-dimethylaminopropyl (2'-O-DMAP), 2'-O-dimethylaminoethyloxyethyl (2'-O-DMAEOE), or 2'-0-N-methylacetamido (2'-O-NMA) modified, LNA, ENA, PNA, HNA, morpholino, methylphosphonate nucleotides, thiolphosphonate nucleotides, 2'-fluoro N3-P5'-phosphoramidites, or a combination thereof. In some instances, the oligonucleotide comprising a compound of Formula (II) (e.g., Formula IIa) further comprises 1, 2, 3, 4, 5, 6, 7, 8, 9, 10, 11, 12, 13, 14, 15, 16, 17, 18, 20, 25, or more of 2'-O-methyl modified nucleotides. In some instances, the oligonucleotide comprising a compound of Formula (II) (e.g., Formula IIa) further comprises 1, 2, 3, 4, 5, 6, 7, 8, 9, 10, 11, 12, 13, 14, 15, 16, 17, 18, 20, 25, or more of 2'-O-methoxyethyl (2'-O-MOE) modified nucleotides. In some instances, the oligonucleotide comprising a compound of Formula (II) (e.g., Formula IIa) further comprises 1, 2, 3, 4, 5, 6, 7, 8, 9, 10, 11, 12, 13, 14, 15, 16, 17, 18, 20, 25, or more of thiolphosphonate nucleotides.

In some instances, about 5 to about 100% of the oligonucleotide comprising a compound of Formula (II) (e.g., Formula IIa) comprise the artificial nucleotide analogues described herein. In some instances, about 5%, 10%, 15%, 20%, 25%, 30%, 35%, 40%, 45%, 50%, 55%, 60%, 65%, 70%, 75%, 80%, 85%, 90%, 95%, or 100% of the polynucleic acid molecule comprise the artificial nucleotide analogues described herein. In some embodiments, the artificial nucleotide analogues include 2'-O-methyl, 2'-O-methoxyethyl (2'-O-MOE), 2'-O-aminopropyl, 2'-deoxy, 2'-deoxy-2'-fluoro, 2'-O-aminopropyl (2'-O-AP), 2'-O-dimethylaminoethyl (2'-O-DMAOE), 2'-O-dimethylaminopropyl (2'-O-DMAP), 2'-O-dimethylaminoethyloxyethyl (2'-O-DMAEOE), or 2'-O—N-methylacetamido (2'-O-NMA) modified, LNA, ENA, PNA, HNA, morpholino, methylphosphonate nucleotides, thiolphosphonate nucleotides, 2'-fluoro N3-P5'-phosphoramidites, or a combination thereof.

In some embodiments, the oligonucleotide (or B) described herein comprises RNA or DNA. In some cases, the oligonucleotide comprises RNA. In some instances, RNA comprises short interfering RNA (siRNA), short hairpin RNA (shRNA), microRNA (miRNA), double-stranded RNA (dsRNA), transfer RNA (tRNA), ribosomal RNA (rRNA), or heterogeneous nuclear RNA (hnRNA). In some instances, RNA comprises shRNA. In some instances, RNA comprises miRNA. In some instances, RNA comprises dsRNA. In some instances, RNA comprises tRNA. In some instances, RNA comprises rRNA. In some instances, RNA comprises hnRNA. In some instances, the RNA comprises siRNA. In some cases, the oligonucleotide comprises a sense strand (or passenger strand) of a siRNA. In other cases, the oligonucleotide comprises an antisense (or guide strand) of a siRNA.

In some embodiments, the oligonucleotide is from about 10 to about 50 nucleotides in length. In some instances, the oligonucleotide is from about 10 to about 30, from about 15 to about 30, from about 18 to about 25, from about 18 to about 24, from about 19 to about 23, or from about 20 to about 22 nucleotides in length.

In some embodiments, the oligonucleotide is about 50 nucleotides in length. In some instances, the oligonucleotide is about 45 nucleotides in length. In some instances, the oligonucleotide is about 40 nucleotides in length. In some instances, the oligonucleotide is about 35 nucleotides in length. In some instances, the oligonucleotide is about 30 nucleotides in length. In some instances, the oligonucleotide is about 25 nucleotides in length. In some instances, the oligonucleotide is about 20 nucleotides in length. In some instances, the oligonucleotide is about 19 nucleotides in length. In some instances, the oligonucleotide is about 18 nucleotides in length. In some instances, the oligonucleotide is about 17 nucleotides in length. In some instances, the oligonucleotide is about 16 nucleotides in length. In some instances, the oligonucleotide is about 15 nucleotides in length. In some instances, the oligonucleotide is about 14 nucleotides in length. In some instances, the oligonucleotide is about 13 nucleotides in length. In some instances, the oligonucleotide is about 12 nucleotides in length. In some instances, the oligonucleotide is about 11 nucleotides in length. In some instances, the oligonucleotide is about 10 nucleotides in length. In some instances, the oligonucleotide is from about 10 to about 50 nucleotides in length. In some instances, the oligonucleotide is from about 10 to about 45 nucleotides in length. In some instances, the oligonucleotide is from about 10 to about 40 nucleotides in length. In some instances, the oligonucleotide is from about 10 to about 35 nucleotides in length. In some instances, the oligonucleotide is from about 10 to about 30 nucleotides in length. In some instances, the oligonucleotide is from about 10 to about 25 nucleotides in length. In some instances, the oligonucleotide is from about 10 to about 20 nucleotides in length. In some instances, the oligonucleotide is from about 15 to about 25 nucleotides in length. In some instances, the oligonucleotide is from about 19 to about 23 nucleotides in length. In some instances, the oligonucleotide is from about 15 to about 30 nucleotides in length. In some instances, the oligonucleotide is from about 12 to about 30 nucleotides in length.

In some embodiments, the oligonucleotide is further hybridized with a second oligonucleotide to form a duplex. In some instances, the oligonucleotide is a sense strand or passenger strand. In some instances, the second oligonucleotide is an antisense strand or guide strand.

In some embodiments, the second oligonucleotide is from about 10 to about 50 nucleotides in length. In some instances, the second oligonucleotide is from about 10 to about 30, from about 15 to about 30, from about 18 to about 25, from about 18 to about 24, from about 19 to about 23, or from about 20 to about 22 nucleotides in length.

In some instances, the second oligonucleotide is about 50 nucleotides in length. In some instances, the second oligonucleotide is about 45 nucleotides in length. In some instances, the second oligonucleotide is about 40 nucleotides in length. In some instances, the second oligonucleotide is about 35 nucleotides in length. In some instances, the second oligonucleotide is about 30 nucleotides in length. In some instances, the second oligonucleotide is about 25 nucleotides in length. In some instances, the second oligonucleotide is about 20 nucleotides in length. In some instances, the second oligonucleotide is about 19 nucleotides in length. In some instances, the second oligonucleotide is about 18 nucleotides in length. In some instances, the second oligonucleotide is about 17 nucleotides in length. In some instances, the second oligonucleotide is about 16 nucleotides in length. In some instances, the second oligonucleotide is about 15 nucleotides in length. In some instances, the second oligonucleotide is about 14 nucleotides in length. In some instances, the second oligonucleotide is about 13 nucleotides in length. In some instances, the second oligonucleotide is about 12 nucleotides in length. In some instances, the second oligonucleotide is about 11 nucleotides in length. In some instances, the second oligonucleotide is about 10 nucleotides in length. In some instances, the second oligonucleotide is from about 10 to about 50 nucleotides in length. In some instances, the second oligonucleotide is from about 10 to about 45 nucleotides in length. In some instances, the second oligonucleotide is from about 10 to about 40 nucleotides in length. In some instances, the second oligonucleotide is from about 10 to about 35 nucleotides in length. In some instances, the second oligonucleotide is from about 10 to about 30 nucleotides in length. In some instances, the second oligonucleotide is from about 10 to about 25 nucleotides in length. In some instances, the second oligonucleotide is from about 10 to about 20 nucleotides in length. In some instances, the second oligonucleotide is from about 15 to about 25 nucleotides in length. In some instances, the second oligonucleotide is from about 15 to about 25 nucleotides in length. In some instances, the second oligonucleotide is from about 15 to about 30 nucleotides in length. In some instances, the second oligonucleotide is from about 12 to about 30 nucleotides in length.

In some embodiments, a polynucleic acid molecule comprises a first oligonucleotide and a second oligonucleotide. In some instances, the polynucleic acid molecule further comprises a blunt terminus, an overhang, or a combination thereof. In some instances, the blunt terminus is a 5' blunt terminus, a 3' blunt terminus, or both. In some cases, the overhang is a 5' overhang, 3' overhang, or both. In some cases, the overhang comprises 1, 2, 3, 4, 5, 6, 7, 8, 9, or 10 non-base pairing nucleotides. In some cases, the overhang comprises 1, 2, 3, 4, 5, or 6 non-base pairing nucleotides. In some cases, the overhang comprises 1, 2, 3, or 4 non-base pairing nucleotides. In some cases, the overhang comprises 1 non-base pairing nucleotide. In some cases, the overhang comprises 2 non-base pairing nucleotides. In some cases, the overhang comprises 3 non-base pairing nucleotides. In some cases, the overhang comprises 4 non-base pairing nucleotides.

In some embodiments, the sequence of the polynucleic acid molecule is at least 40%, 50%, 55%, 60%, 65%, 70%, 75%, 80%, 85%, 90%, 95%, 98%, 99%, or 99.5% complementary to a target sequence described herein. Exemplary target sequence includes, but not limited to, any sequences of DMD gene or its mRNA, DMPK gene or its mRNA, any sequences of an oncogene or its mRNA, any genes related to hereditary or genetic diseases (e.g., GYS1), any sequences of a gene related to muscle atrophy, muscle dystrophy, or muscle wasting (e.g., DMD, DMPK, DUX4) and its mRNA. In some embodiments, the sequence of the polynucleic acid molecule is at least 50% complementary to a target sequence described herein. In some embodiments, the sequence of the polynucleic acid molecule is at least 60% complementary to a target sequence described herein. In some embodiments, the sequence of the polynucleic acid molecule is at least 70% complementary to a target sequence described herein. In some embodiments, the sequence of the polynucleic acid molecule is at least 80% complementary to a target sequence described herein. In some embodiments, the sequence of the polynucleic acid molecule is at least 90% complementary to a target sequence described herein. In some embodiments, the sequence of the polynucleic acid molecule is at least 95% complementary to a target sequence described herein. In some embodiments, the sequence of the polynucleic acid molecule is at least 99% complementary to a target sequence described herein. In some instances, the sequence of the polynucleic acid molecule is 100% complementary to a target sequence described herein.

In some embodiments, the sequence of the polynucleic acid molecule has 5 or less mismatches to a target sequence described herein. In some embodiments, the sequence of the polynucleic acid molecule has 4 or less mismatches to a target sequence described herein. In some instances, the sequence of the polynucleic acid molecule has 3 or less mismatches to a target sequence described herein. In some cases, the sequence of the polynucleic acid molecule has 2 or less mismatches to a target sequence described herein. In some cases, the sequence of the polynucleic acid molecule has 1 or less mismatches to a target sequence described herein.

In some embodiments, the specificity of the polynucleic acid molecule that hybridizes to a target sequence described herein is a 95%, 98%, 99%, 99.5%, or 100% sequence complementarity of the polynucleic acid molecule to a target sequence. In some instances, the hybridization is a high stringent hybridization condition.

In some embodiments, the polynucleic acid molecule hybridizes to at least 8, 9, 10, 11, 12, 13, 14, 15, 16, 17, 18, 19, 20, or more contiguous bases of a target sequence described herein. In some embodiments, the polynucleic acid molecule hybridizes to at least 8 contiguous bases of a target sequence described herein. In some embodiments, the polynucleic acid molecule hybridizes to at least 9 contiguous bases of a target sequence described herein. In some embodiments, the polynucleic acid molecule hybridizes to at least 10 contiguous bases of a target sequence described herein. In some embodiments, the polynucleic acid molecule hybridizes to at least 11 contiguous bases of a target sequence described herein. In some embodiments, the polynucleic acid molecule hybridizes to at least 12 contiguous bases of a target sequence described herein. In some embodiments, the polynucleic acid molecule hybridizes to at least 13 contiguous bases of a target sequence described herein. In some embodiments, the polynucleic acid molecule hybridizes to at least 14 contiguous bases of a target sequence described herein. In some embodiments, the polynucleic acid molecule hybridizes to at least 15 contiguous bases of a target sequence described herein. In some embodiments, the polynucleic acid molecule hybridizes to at least 16 contiguous bases of a target sequence described herein. In some embodiments, the polynucleic acid molecule hybridizes to at least 17 contiguous bases of a target sequence described herein. In some embodiments, the polynucleic acid molecule hybridizes to at least 18 contiguous bases of a target sequence described herein. In some embodiments, the polynucleic acid molecule hybridizes to at least 19 contiguous bases of a target sequence described herein. In some embodiments, the polynucleic acid molecule hybridizes to at least 20 contiguous bases of a target sequence described herein.

In some embodiments, the polynucleic acid molecule has reduced off-target effect. In some instances, "off-target" or "off-target effects" refer to any instance in which a polynucleic acid polymer directed against a given target causes an unintended effect by interacting either directly or indirectly with another mRNA sequence, a DNA sequence or a cellular protein or other moiety. In some instances, an "off-target effect" occurs when there is a simultaneous degradation of other transcripts due to partial homology or complementarity between that other transcript and the sense and/or antisense strand of the polynucleic acid molecule.

In some cases, one or more of the artificial nucleotide analogues described herein are resistant toward nucleases such as for example ribonuclease such as RNase H, deoxyribunuclease such as DNase, or exonuclease such as 5'-3' exonuclease and 3'-5' exonuclease when compared to natural polynucleic acid molecules. In some instances, artificial nucleotide analogues comprising a compound of Formula II (e.g., Formula IIa), 2'-O-methyl, 2'-O-methoxyethyl (2'-O-MOE), 2'-O-aminopropyl, 2'-deoxy, 2'-deoxy-2'-fluoro, 2'-O-aminopropyl (2'-O-AP), 2'-O-dimethylaminoethyl (2'-O-DMAOE), 2'-O-dimethylaminopropyl (2'-O-DMAP), 2'-O-dimethylaminoethyloxyethyl (2'-O-DMAEOE), or 2'-O—N-methylacetamido (2'-O-NMA) modified, LNA, ENA, PNA, HNA, morpholino, methylphosphonate nucleotides, thiolphosphonate nucleotides, 2'-fluoro N3-P5'-phosphoramidites, or combinations thereof are resistant toward nucleases such as for example ribonuclease such as RNase H, deoxyribunuclease such as DNase, or exonuclease such as 5'-3' exonuclease and 3'-5' exonuclease. In some instances, 2'-O-methyl modified polynucleic acid molecule is nuclease resistant (e.g., RNase H, DNase, 5'-3' exonuclease or 3'-5' exonuclease resistant). In some instances, 2'O-methoxyethyl (2'-O-MOE) modified polynucleic acid molecule is nuclease resistant (e.g., RNase H, DNase, 5'-3' exonuclease or 3'-5' exonuclease resistant). In some instances, 2'-O-aminopropyl modified polynucleic acid molecule is nuclease resistant (e.g., RNase H, DNase, 5'-3' exonuclease or 3'-5' exonuclease resistant). In some instances, 2'-deoxy modified polynucleic acid molecule is nuclease resistant (e.g., RNase H, DNase, 5'-3' exonuclease or 3'-5' exonuclease resistant). In some instances, 2'-deoxy-2'-fluoro modified polynucleic acid molecule is nuclease resistant (e.g., RNase H, DNase, 5'-3' exonuclease or 3'-5' exonuclease resistant). In some instances, 2'-O-aminopropyl (2'-O-AP) modified polynucleic acid molecule is nuclease resistant (e.g., RNase H, DNase, 5'-3' exonuclease or 3'-5' exonuclease resistant). In some instances, 2'-O-dimethylaminoethyl (2'-O-DMAOE) modified polynucleic acid molecule is nuclease resistant (e.g., RNase H, DNase, 5'-3' exonuclease or 3'-5' exonuclease resistant). In some instances, 2'-O-dimethylaminopropyl (2'-O-DMAP) modified polynucleic acid molecule is nuclease resistant (e.g., RNase H, DNase, 5'-3' exonuclease or 3'-5' exonuclease resistant). In some instances, 2'-O-dimethylaminoethyloxyethyl (2'-O-DMAEOE) modified polynucleic acid molecule is nuclease resistant (e.g., RNase H, DNase, 5'-3' exonuclease or 3'-5' exonuclease resistant). In some instances, 2'-O—N-methylacetamido (2'-O-NMA) modified polynucleic acid molecule is nuclease resistant (e.g., RNase H, DNase, 5'-3' exonuclease or 3'-5' exonuclease resistant). In some instances, LNA-modified polynucleic acid molecule is nuclease resistant (e.g., RNase H, DNase, 5'-3' exonuclease or 3'-5' exonuclease resistant). In some instances, ENA-modified polynucleic acid molecule is nuclease resistant (e.g., RNase H, DNase, 5'-3' exonuclease or 3'-5' exonuclease resistant). In some instances, HNA-modified polynucleic acid molecule is nuclease resistant (e.g., RNase H, DNase, 5'-3' exonuclease or 3'-5' exonuclease resistant). Morpholinos may be nuclease resistant (e.g., RNase H, DNase, 5'-3' exonuclease or 3'-5' exonuclease resistant). In some instances, PNA-modified polynucleic acid molecule is resistant to nucleases (e.g., RNase H, DNase, 5'-3' exonuclease or 3'-5' exonuclease resistant). In some instances, methylphosphonate nucleotide-modified polynucleic acid molecule is nuclease resistant (e.g., RNase H, DNase, 5'-3' exonuclease or 3'-5' exonuclease resistant). In some instances, thiolphosphonate nucleotide-modified polynucleic acid molecule is nuclease resistant (e.g., RNase H, DNase, 5'-3' exonuclease or 3'-5' exonuclease resistant). In some instances, polynucleic acid molecule comprising 2'-fluoro N3-P5'-phosphoramidites is nuclease resistant (e.g., RNase H, DNase, 5'-3' exonuclease or 3'-5' exonuclease resistant). In some instances, the 5' conjugates described herein inhibit 5'-3' exonucleolytic cleavage. In some instances, the 3' conjugates described herein inhibit 3'-5' exonucleolytic cleavage.

In some embodiments, one or more of the artificial nucleotide analogues comprising a compound of Formula II (e.g., Formula IIa), described herein have increased binding affinity toward their mRNA target relative to an equivalent natural polynucleic acid molecule. The one or more of the artificial nucleotide analogues comprising a compound of Formula II (e.g., Formula IIa), 2'-O-methyl, 2'-O-methoxyethyl (2'-O-MOE), 2'-O-aminopropyl, 2'-deoxy, 2'-deoxy-2'-fluoro, 2'-O-aminopropyl (2'-O-AP), 2'-O-dimethylaminoethyl (2'-O-DMAOE), 2'-O-dimethylaminopropyl (2'-O-DMAP), 2'-O-dimethylaminoethyloxyethyl (2'-O-DMAEOE), or 2'-O—N-methylacetamido (2'-O-NMA) modified, LNA, ENA, PNA, HNA, morpholino, methylphosphonate nucleotides, thiolphosphonate nucleotides, or 2'-fluoro N3-P5'-phosphoramidites can have increased binding affinity toward their mRNA target relative to an equivalent natural polynucleic acid molecule. In some instances, 2'-O-methyl modified polynucleic acid molecule has increased binding affinity toward their mRNA target relative to an equivalent natural polynucleic acid molecule. In some instances, 2'-O-methoxyethyl (2'-O-MOE) modified polynucleic acid molecule has increased binding affinity toward their mRNA target relative to an equivalent natural polynucleic acid molecule. In some instances, 2'-O-aminopropyl modified polynucleic acid molecule has increased binding affinity toward their mRNA target relative to an equivalent natural polynucleic acid molecule. In some instances, 2'-deoxy modified polynucleic acid molecule has increased binding affinity toward their mRNA target relative to an equivalent natural polynucleic acid molecule. In some instances, 2'-deoxy-2'-fluoro modified polynucleic acid molecule has increased binding affinity toward their mRNA target relative to an equivalent natural polynucleic acid molecule. In some instances, 2'-O-aminopropyl (2'-O-AP) modified polynucleic acid molecule has increased binding affinity toward their mRNA target relative to an equivalent natural polynucleic acid molecule. In some instances, 2'-O-dimethylaminoethyl (2'-O-DMAOE) modified polynucleic acid molecule has increased binding affinity toward their mRNA target relative to an equivalent natural polynucleic acid molecule. In some instances, 2'-O-dimethylaminopropyl (2'-O-DMAP) modified polynucleic acid molecule has increased binding affinity toward their mRNA target relative to an equivalent natural polynucleic acid molecule. In some instances, 2'-O-dimethylaminoethyloxyethyl (2'-O-DMAEOE) modified polynucleic acid molecule has increased binding affinity toward their mRNA target relative to an equivalent natural polynucleic acid molecule. In some instances, 2'-O—N-methylacetamido (2'-O-NMA) modified polynucleic acid molecule has increased binding affinity toward their mRNA target relative to an equivalent natural polynucleic acid molecule. In some instances, LNA-modified polynucleic acid molecule has increased binding affinity toward their mRNA target relative to an equivalent natural polynucleic acid molecule. In some instances, ENA-modified polynucleic acid molecule has increased binding affinity toward their mRNA target relative to an equivalent natural polynucleic acid molecule. In some instances, PNA-modified polynucleic acid molecule has increased binding affinity toward their mRNA target relative to an equivalent natural polynucleic acid molecule. In some instances, HNA-modified polynucleic acid molecule has increased binding affinity toward their mRNA target relative to an equivalent natural polynucleic acid molecule. In some instances, morpholino-modified polynucleic acid molecule has increased binding affinity toward their mRNA target relative to an equivalent natural polynucleic acid molecule. In some instances, methylphosphonate nucleotide-modified polynucleic acid molecule has increased binding affinity toward their mRNA target relative to an equivalent natural polynucleic acid molecule. In some instances, thiolphosphonate nucleotide-modified polynucleic acid molecule has increased binding affinity toward their mRNA target relative to an equivalent natural polynucleic acid molecule. In some instances, polynucleic acid molecule comprising 2'-fluoro N3-P5'-phosphoramidites has increased binding affinity toward their mRNA target relative to an equivalent natural polynucleic acid molecule. In some cases, the increased affinity is illustrated with a lower Kd, a higher melt temperature (Tm), or a combination thereof.

In some embodiments, an artificial nucleotide analogues comprising a compound of Formula II (e.g., Formula IIa), described herein is a chirally pure (or stereo pure) polynucleic acid molecule, or a polynucleic acid molecule comprising a single enantiomer. In some instances, the polynucleic acid molecule comprises L-nucleotide. In some instances, the polynucleic acid molecule comprises D-nucleotides. In some instance, a polynucleic acid molecule composition comprises less than 30%, 25%, 20%, 15%, 10%, 5%, 4%, 3%, 2%, 1%, or less of its mirror enantiomer. In some cases, a polynucleic acid molecule composition comprises less than 30%, 25%, 20%, 15%, 10%, 5%, 4%, 3%, 2%, 1%, or less of a racemic mixture. In some instances, the polynucleic acid molecule is a polynucleic acid molecule described in: U.S. Patent Publication Nos: 2014/194610 and 2015/211006; and PCT Publication No.: WO2015107425.

In some embodiments, a polynucleic acid molecule described herein is further modified to include an aptamer-conjugating moiety. In some instances, the aptamer conjugating moiety is a DNA aptamer-conjugating moiety. In some instances, the aptamer-conjugating moiety is Alphamer (Centauri Therapeutics), which comprises an aptamer portion that recognizes a specific cell-surface target and a portion that presents a specific epitopes for attaching to circulating antibodies. In some instance, a polynucleic acid molecule described herein is further modified to include an aptamer-conjugating moiety as described in: U.S. Pat. Nos. 8,604,184, 8,591,910, and 7,850,975.

In additional embodiments, a polynucleic acid molecule described herein is modified to increase its stability. In some embodiment, the polynucleic acid molecule is RNA (e.g., siRNA), the polynucleic acid molecule is modified to increase its stability. In some instances, the polynucleic acid molecule is modified by one or more of the modifications described above to increase its stability. In some cases, the polynucleic acid molecule is modified at the 2' hydroxyl position, such as by 2'-O-methyl, 2'-O-methoxyethyl (2'-O-MOE), 2'-O-aminopropyl, 2'-deoxy, 2'-deoxy-2'-fluoro, 2'-O-aminopropyl (2'-O-AP), 2'-O-dimethylaminoethyl (2'-O-DMAOE), 2'-0-dimethylaminopropyl (2'-O-DMAP), 2'-O-dimethylaminoethyloxyethyl (2'-O-DMAEOE), or 2'-O—N-methylacetamido (2'-O-NMA) modification or by a locked or bridged ribose conformation (e.g., LNA or ENA). In some cases, the polynucleic acid molecule is modified by 2'-O-methyl and/or 2'-O-methoxyethyl ribose. In some cases, the polynucleic acid molecule also includes morpholinos, PNAs, HNA, methylphosphonate nucleotides, thiolphosphonate nucleotides, and/or 2'-fluoro N3-P5'-phosphoramidites to increase its stability. In some instances, the polynucleic acid molecule is a chirally pure (or stereo pure) polynucleic acid molecule. In some instances, the chirally pure (or stereo pure) polynucleic acid molecule is modified to increase its stability. Suitable modifications to the RNA to increase stability for delivery will be apparent to the skilled person.

In some embodiments, a polynucleic acid molecule described herein has RNAi activity that modulates expression of RNA encoded by a gene described supra. In some instances, a polynucleic acid molecule described herein is a double-stranded siRNA molecule that down-regulates expression of a gene, wherein one of the strands of the double-stranded siRNA molecule comprises a nucleotide sequence that is complementary to a nucleotide sequence of the gene or RNA encoded by the gene or a portion thereof, and wherein the second strand of the double-stranded siRNA molecule comprises a nucleotide sequence substantially similar to the nucleotide sequence of the gene or RNA encoded by the gene or a portion thereof. In some cases, a polynucleic acid molecule described herein is a double-stranded siRNA molecule that down-regulates expression of a gene, wherein each strand of the siRNA molecule comprises about 15 to 25, 18 to 24, or 19 to about 23 nucleotides, and wherein each strand comprises at least about 14, 17, or 19 nucleotides that are complementary to the nucleotides of the other strand. In some cases, a polynucleic acid molecule described herein is a double-stranded siRNA molecule that down-regulates expression of a gene, wherein each strand of the siRNA molecule comprises about 19 to about 23 nucleotides, and wherein each strand comprises at least about 19 nucleotides that are complementary to the nucleotides of the other strand.

In some embodiments, a polynucleic acid molecule described herein is constructed using chemical synthesis and/or enzymatic ligation reactions using procedures known in the art. For example, a polynucleic acid molecule is chemically synthesized using naturally occurring nucleotides or variously modified nucleotides designed to increase the biological stability of the molecules or to increase the physical stability of the duplex formed between the polynucleic acid molecule and target nucleic acids. Exemplary methods include those described in: U.S. Pat. Nos. 5,142,047; 5,185,444; 5,889,136; 6,008,400; and 6,111,086; PCT Publication No. WO2009099942; or European Publication No. 1579015. Additional exemplary methods include those described in: Griffey et al., "2'-O-aminopropyl ribonucleotides: a zwitterionic modification that enhances the exonuclease resistance and biological activity of antisense oligonucleotides," *J. Med. Chem.* 39(26):5100-5109 (1997)); Obika, et al. "Synthesis of 2'-O,4'-C-methyleneuridine and -cytidine. Novel bicyclic nucleosides having a fixed $C_3$, -endo sugar puckering". *Tetrahedron Letters* 38 (50): 8735 (1997); Koizumi, M. "ENA oligonucleotides as therapeutics". *Current opinion in molecular therapeutics* 8 (2): 144-149 (2006); and Abramova et al., "Novel oligonucleotide analogues based on morpholino nucleoside subunits-antisense technologies: new chemical possibilities," Indian Journal of Chemistry 48B:1721-1726 (2009). Alternatively, the polynucleic acid molecule is produced biologically using an expression vector into which a polynucleic acid molecule has been subcloned in an antisense orientation (i.e., RNA transcribed from the inserted polynucleic acid molecule will be of an antisense orientation to a target polynucleic acid molecule of interest).

One embodiment provides an oligonucleotide conjugate of Formula (I) or Formula (I-A):

A-B                    Formula (I);

wherein,
A is a binding moiety;
B is an oligonucleotide comprising a compound of Formula (II) or (IIa).

A-B-C                  Formula (I-A);

wherein,
A is a binding moiety; and
B is an oligonucleotide comprising a compound of Formula (II) or (IIa)
C is optionally a polymer. One embodiment provides an oligonucleotide conjugate of Formula (I) or Formula (I-A):

A-B                    Formula (I);

A-B-C                  Formula (I-A);

wherein,
A is a binding moiety;
C is optionally a polymer; and
B is an oligonucleotide comprising a compound of Formula (II-1), (II-2), or (II-3):

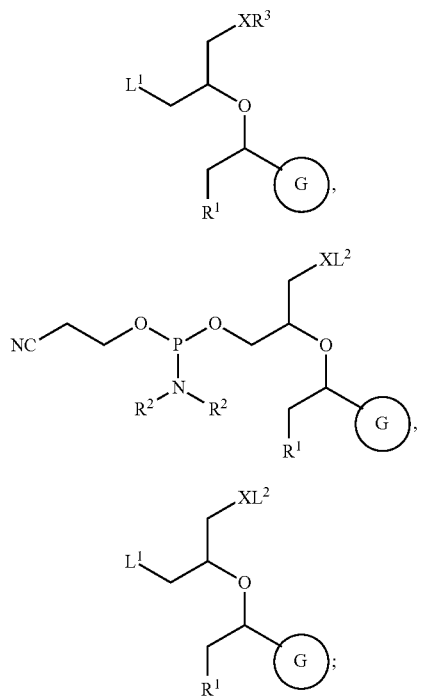

wherein,
Ring G is

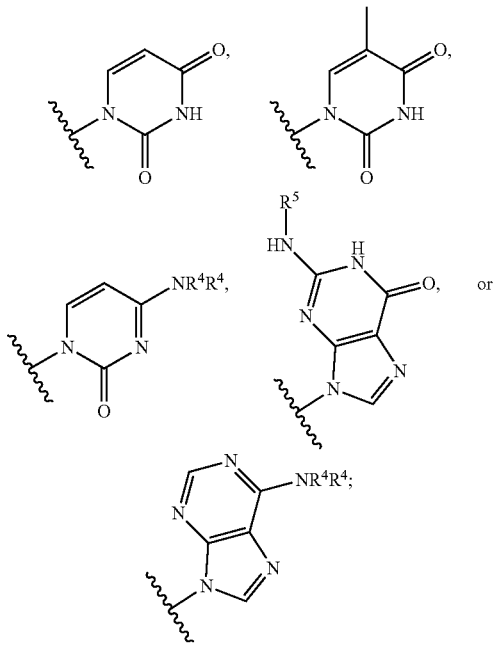

X is O, NH, or C(=O);
$L^1$ and $L^2$ are each independently absent or a linking moiety selected from a phosphodiester, amide, and ester linkage:
$R^1$ is hydrogen, deuterium, halogen, substituted or unsubstituted $C_1$-$C_{10}$ alkyl, substituted or unsubstituted $C_2$-$C_{10}$ alkenyl, substituted or unsubstituted $C_2$-$C_{10}$ alkynyl, substituted or unsubstituted $C_1$-$C_{10}$ fluoroalkyl, substituted or unsubstituted $C_1$-$C_{20}$ heteroalkyl, substituted or unsubstituted cycloalkyl, substituted or unsubstituted heterocycloalkyl, substituted or unsubstituted aryl, substituted or unsubstituted heteroaryl, substituted or unsubstituted —O-aryl, —OR$^6$, —C(=O) R$^6$, —C(=O)OR$^6$, —C(=O)NR$^7$R$^7$, —OCH$_2$C(=O) R$^6$, —OCH$_2$C(=O)OR$^6$, or —OCH$_2$C(=O)NR$^7$R$^7$;
each $R^2$ is independently hydrogen, deuterium, or substituted or unsubstituted $C_1$-$C_{10}$ alkyl;
or two $R^2$ are taken together with the nitrogen atom to which they are attached to form a substituted or unsubstituted $C_3$-$C_{10}$ heterocycloalkyl;
$R^3$ is hydrogen, 4,4'-dimethoxytrityl (DMT), —R$^6$, —OR$^6$, or —NR$^7$R$^7$;
each $R^4$ is independently hydrogen, substituted or unsubstituted $C_1$-$C_6$alkyl, substituted or unsubstituted aryl, or substituted or unsubstituted benzoyl;
$R^5$ is —C(=O)OR$^6$;
each $R^6$ and $R^7$ are independently hydrogen, substituted or unsubstituted $C_1$-$C_6$alkyl, substituted or unsubstituted $C_1$-$C_6$fluoroalkyl, substituted or unsubstituted $C_3$-$C_6$cycloalkyl, substituted or unsubstituted heterocycloalkyl, substituted or unsubstituted aryl, or substituted or unsubstituted heteroaryl.

In some embodiments of the oligonucleotide conjugate of Formula (I), B is a compound having the structure of Formula (II-1). In some embodiments of the oligonucleotide conjugate of Formula (I), B is a compound having the structure of Formula (II-2). In some embodiments of the oligonucleotide conjugate of Formula (I), B is a compound having the structure of Formula (II-3).

One embodiment provides an oligonucleotide conjugate of Formula (Xa):

A-X-B'-Y-C    Formula (Xa);

wherein,
A is a binding moiety;
B' is an oligonucleotide comprising compound of Formula (II) or (IIa);
C is optionally a polymer;
X is a bond or a first linker; and
Y is a bond or a second linker;
wherein the polynucleotide further comprises one or more additional non-natural nucleotides; and
wherein A and C are not attached to B at the same terminus.

Another embodiment provides the oligonucleotide comprising a compound of Formula (I) or an oligonucleotide conjugate of Formula (Xa), wherein the oligonucleotide further comprises, at least one modified internucleotide linkage, or at least one inverted abasic moiety.

Another embodiment provides the oligonucleotide comprising a compound of Formula (I) or an oligonucleotide conjugate of Formula (Xa), wherein the compound of Formula II is located at the 5'-terminus of the oligonucleotide.

Another embodiment provides the oligonucleotide comprising a compound of Formula (I) or an oligonucleotide conjugate of Formula (Xa), wherein the compound of Formula II is located at an internucleotide linkage of the oligonucleotide.

Another embodiment provides the oligonucleotide comprising a compound of Formula (I) or an oligonucleotide conjugate of Formula (Xa), wherein the compound of Formula II is further modified at the 2'-position.

Another embodiment provides the oligonucleotide comprising a compound of Formula (I) or an oligonucleotide conjugate of Formula (Xa), wherein the one or more additional non-natural nucleotides comprises a 2'-modification selected from 2'-O-methyl, 2'-O-methoxyethyl (2'-O-MOE), 2'-deoxy, 2'-deoxy-2'-fluoro, 2'-O-aminopropyl (2'-O-AP), 2'-O-dimethylaminoethyl (2'-O-DMAOE), 2'-O-dimethylaminopropyl (2'-O-DMAP), 2'-O-dimethylaminoethyloxyethyl (2'-O-DMAEOE), or 2'-O—N-methylacetamido (2'-O-NMA) modified nucleotide.

Another embodiment provides the oligonucleotide comprising a compound of Formula (I) or an oligonucleotide conjugate of Formula (Xa), wherein the compound of Formula II is selected from locked nucleic acid (LNA) or ethylene nucleic acid (ENA).

Another embodiment provides the oligonucleotide comprising a compound of Formula (I) or an oligonucleotide conjugate of Formula (Xa), wherein the at least one inverted abasic moiety is at least one terminus.

Another embodiment provides the oligonucleotide comprising a compound of Formula (I) or an oligonucleotide conjugate of Formula (Xa), wherein the oligonucleotide is single stranded. Another embodiment provides the oligonucleotide of Formula (Xa), wherein the oligonucleotide is double stranded.

Another embodiment provides the oligonucleotide comprising a compound of Formula (I) or an oligonucleotide conjugate of Formula (Xa), wherein the oligonucleotide is from 2 to about 100 residues in length. Another embodiment provides the oligonucleotide comprising a compound of Formula (I) or an oligonucleotide conjugate of Formula (Xa), wherein the oligonucleotide is from 2 to about 90 residues in length. Another embodiment provides the oligonucleotide of Formula (I) or (Xa), wherein the oligonucleotide is from 2 to about 80 residues in length. Another embodiment provides the oligonucleotide of Formula (I) or (Xa), wherein the oligonucleotide is from 2 to about 70 residues in length. Another embodiment provides the oligonucleotide of Formula (I) or (Xa), wherein the oligonucleotide is from 2 to about 60 residues in length. Another embodiment provides the oligonucleotide of Formula (I) or (Xa), wherein the oligonucleotide is from 2 to about 50 residues in length. Another embodiment provides the oligonucleotide of Formula (I) or (Xa), wherein the oligonucleotide is from 2 to about 40 residues in length. Another embodiment provides the oligonucleotide of Formula (I) or (Xa), wherein the oligonucleotide is from 2 to about 30 residues in length. Another embodiment provides the oligonucleotide of Formula (I) or (Xa), wherein the oligonucleotide is from 2 to about 20 residues in length. Another embodiment provides the oligonucleotide of Formula (I) or (Xa), wherein the oligonucleotide is from 2 to about 10 residues in length. Another embodiment provides the oligonucleotide of Formula (I) or (Xa), wherein the oligonucleotide is from 8 to about 30 residues in length. Another embodiment provides the oligonucleotide of Formula (Xa), wherein the oligonucleotide is from 10 to about 30 residues in length. Another embodiment provides the oligonucleotide of Formula (I) or (Xa), wherein the oligonucleotide is from 14 to about 30 residues in length. Another embodiment provides the oligonucleotide of Formula (Xa), wherein the oligonucleotide is from 18 to about 30 residues in length. Another embodiment provides the oligonucleotide of Formula (I) or (Xa), wherein the oligonucleotide is from 22 to about 30 residues in length. Another embodiment provides the oligonucleotide of Formula (I) or (X), wherein the oligonucleotide is from 26 to about 30 residues in length.

One embodiment provides a compound suitable for the synthesis of oligonucleotides selected from the group:

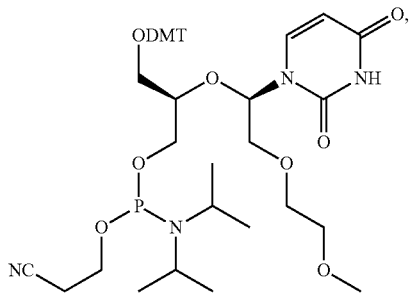

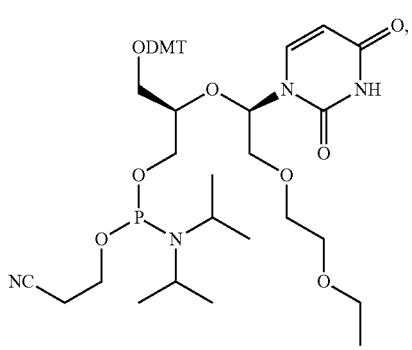

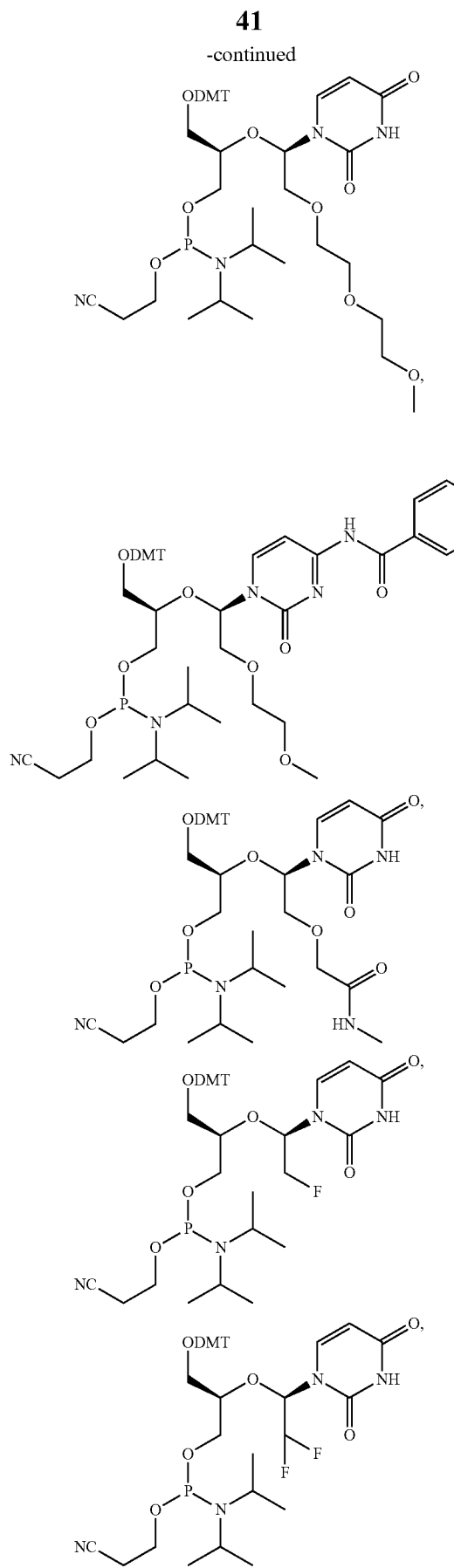
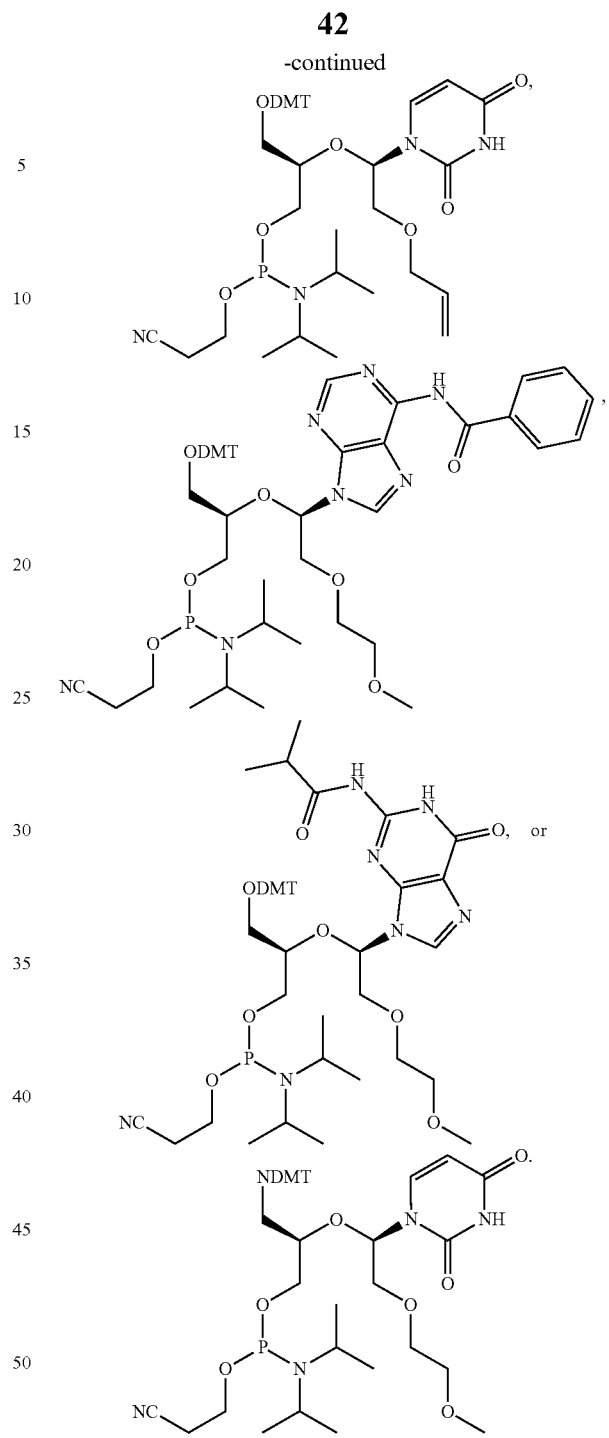

Conjugation Chemistry

In some embodiments, a polynucleic acid molecule is conjugated to a binding moiety. In some instances, the binding moiety comprises amino acids, peptides, polypeptides, proteins, antibodies, antigens, toxins, hormones, lipids, nucleotides, nucleosides, sugars, carbohydrates, polymers such as polyethylene glycol and polypropylene glycol, as well as analogs or derivatives of all of these classes of substances. Additional examples of binding moiety also include steroids, such as cholesterol, phospholipids, di- and triacylglycerols, fatty acids, hydrocarbons (e.g., saturated, unsaturated, or contains substitutions), enzyme substrates, biotin, digoxigenin, and polysaccharides. In some instances, the binding moiety is an antibody or binding fragment thereof. In some instances, the polynucleic acid molecule is further conjugated to a polymer, and optionally an endosomolytic moiety.

In some embodiments, the polynucleic acid molecule is conjugated to the binding moiety by a chemical ligation process. In some instances, the polynucleic acid molecule is conjugated to the binding moiety by a native ligation. In some instances, the conjugation is as described in: Dawson, et al. "Synthesis of proteins by native chemical ligation," *Science* 1994, 266, 776-779; Dawson, et al. "Modulation of Reactivity in Native Chemical Ligation through the Use of Thiol Additives," *J. Am. Chem. Soc.* 1997, 119, 4325-4329; Hackeng, et al. "Protein synthesis by native chemical ligation: Expanded scope by using straightforward methodology.," *Proc. Natl. Acad. Sci. USA* 1999, 96, 10068-10073; or Wu, et al. "Building complex glycopeptides: Development of a cysteine-free native chemical ligation protocol," *Angew. Chem. Int. Ed.* 2006, 45, 4116-4125. In some instances, the conjugation is as described in U.S. Pat. No. 8,936,910. In some embodiments, the polynucleic acid molecule is conjugated to the binding moiety either site-specifically or non-specifically via native ligation chemistry.

In some instances, the polynucleic acid molecule is conjugated to the binding moiety by a site-directed method utilizing a "traceless" coupling technology (Philochem). In some instances, the "traceless" coupling technology utilizes an N-terminal 1,2-aminothiol group on the binding moiety which is then conjugate with a polynucleic acid molecule containing an aldehyde group. (see Casi et al., "Site-specific traceless coupling of potent cytotoxic drugs to recombinant antibodies for pharmacodelivery," *JACS* 134(13): 5887-5892 (2012))

In some instances, the polynucleic acid molecule is conjugated to the binding moiety by a site-directed method utilizing an unnatural amino acid incorporated into the binding moiety. In some instances, the unnatural amino acid comprises p-acetylphenylalanine (pAcPhe). In some instances, the keto group of pAcPhe is selectively coupled to an alkoxy-amine derivative conjugating moiety to form an oxime bond. (see Axup et al., "Synthesis of site-specific antibody-drug conjugates using unnatural amino acids," *PNAS* 109(40): 16101-16106 (2012)).

In some instances, the polynucleic acid molecule is conjugated to the binding moiety by a site-directed method utilizing an enzyme-catalyzed process. In some instances, the site-directed method utilizes SMARTag™ technology (Redwood). In some instances, the SMARTag™ technology comprises generation of a formylglycine (FGly) residue from cysteine by formylglycine-generating enzyme (FGE) through an oxidation process under the presence of an aldehyde tag and the subsequent conjugation of FGly to an alkylhydraine-functionalized polynucleic acid molecule via hydrazino-Pictet-Spengler (HIPS) ligation. (see Wu et al., "Site-specific chemical modification of recombinant proteins produced in mammalian cells by using the genetically encoded aldehyde tag," *PNAS* 106(9): 3000-3005 (2009); Agarwal, et al., "A Pictet-Spengler ligation for protein chemical modification," *PNAS* 110(1): 46-51 (2013)).

In some instances, the enzyme-catalyzed process comprises microbial transglutaminase (mTG). In some cases, the polynucleic acid molecule is conjugated to the binding moiety utilizing a microbial transglutaminze catalyzed process. In some instances, mTG catalyzes the formation of a covalent bond between the amide side chain of a glutamine within the recognition sequence and a primary amine of a functionalized polynucleic acid molecule. In some instances, mTG is produced from *Streptomyces mobarensis*. (see Strop et al., "Location matters: site of conjugation modulates stability and pharmacokinetics of antibody drug conjugates," *Chemistry and Biology* 20(2) 161-167 (2013))

In some instances, the polynucleic acid molecule is conjugated to the binding moiety by a method as described in PCT Publication No. WO2014/140317, which utilizes a sequence-specific transpeptidase.

In some instances, the polynucleic acid molecule is conjugated to the binding moiety by a method as described in U.S. Patent Publication Nos. 2015/0105539 and 2015/0105540.

Binding Moiety

In some embodiments, the binding moiety A is a polypeptide. In some instances, the polypeptide is an antibody or its fragment thereof. In some cases, the fragment is a binding fragment. In some instances, the antibody or binding fragment thereof comprises a humanized antibody or binding fragment thereof, murine antibody or binding fragment thereof, human antibody or binding fragment thereof, anti-murine antibody (e.g., anti-mouse antibody, anti-rat antibody, etc.), anti-human antibody, chimeric antibody or binding fragment thereof, monoclonal antibody or binding fragment thereof, monovalent Fab', divalent $Fab_2$, $F(ab)'_3$ fragments, single-chain variable fragment (scFv), bis-scFv, $(scFv)_2$, diabody, minibody, nanobody, triabody, tetrabody, disulfide stabilized Fv protein (dsFv), single-domain antibody (sdAb), Ig NAR, camelid antibody or binding fragment thereof, bispecific antibody or biding fragment thereof, or a chemically modified derivative thereof.

In some instances, A is an antibody or binding fragment thereof. In some instances, A is a humanized antibody or binding fragment thereof, murine antibody or binding fragment thereof, chimeric antibody or binding fragment thereof, monoclonal antibody or binding fragment thereof, monovalent Fab', divalent $Fab_2$, $F(ab)'_3$ fragments, single-chain variable fragment (scFv), bis-scFv, $(scFv)_2$, diabody, minibody, nanobody, triabody, tetrabody, disulfide stabilized Fv protein ("dsFv"), single-domain antibody (sdAb), Ig NAR, camelid antibody or binding fragment thereof, bispecific antibody or biding fragment thereof, or a chemically modified derivative thereof. In some instances, A is a humanized antibody or binding fragment thereof. In some instances, A is a murine antibody or binding fragment thereof. In some instances, A is a chimeric antibody or binding fragment thereof. In some instances, A is a monoclonal antibody or binding fragment thereof. In some instances, A is a full size antibody. In some instances, A is a monovalent Fab'. In some instances, A is a divalent $Fab_2$. In some instances, A is a single-chain variable fragment (scFv).

In some embodiments, the binding moiety A is a bispecific antibody or binding fragment thereof. In some instances, the bispecific antibody is a trifunctional antibody or a bispecific mini-antibody. In some cases, the bispecific antibody is a trifunctional antibody. In some instances, the trifunctional antibody is a full length monoclonal antibody comprising binding sites for two different antigens. Exemplary trifunctional antibodies include catumaxomab (which targets EpCAM and CD3; Fresenius Biotech/Trion Pharma), ertumaxomab (targets HER2/neu/CD3; Fresenius Biotech/Trion Pharma), lymphomun FBTA05 (targets CD20/CD3; Fresenius Biotech/Trion Pharma), RG7221 (RO5520985; targets Angiopoietin 2/VEGF; Roche), RG7597 (targets Her1/Her3; Genentech/Roche), MM141 (targets IGF1R/Her3; Merrimack), ABT122 (targets TNFα/IL17; Abbvie), ABT981 (targets IL1α/IL1β; Abbott), LY3164530 (targets Her1/ cMET; Eli Lilly), and TRBS07 (Ektomab; targets GD2/ CD3; Trion Research Gmbh). Additional exemplary trifunctional antibodies include mAb² from F-star Biotechnology Ltd. In some instances, A is a bispecific trifunctional antibody. In some embodiments, A is a bispecific trifunctional antibody selected from: catumaxomab (which targets EpCAM and CD3; Fresenius Biotech/Trion Pharma), ertumaxomab (targets HER2/neu/CD3; Fresenius Biotech/Trion Pharma), lymphomun FBTA05 (targets CD20/CD3; Fresenius Biotech/Trion Pharma), RG7221 (RO5520985; targets Angiopoietin 2/VEGF; Roche), RG7597 (targets Her1/Her3; Genentech/Roche), MM141 (targets IGF1R/Her3; Merrimack), ABT122 (targets TNFα/IL17; Abbvie), ABT981 (targets IL1α/IL1β; Abbott), LY3164530 (targets Her1/cMET; Eli Lilly), TRBS07 (Ektomab; targets GD2/CD3; Trion Research Gmbh), and a mAb² from F-star Biotechnology Ltd.

In some cases, the bispecific antibody is a bispecific mini-antibody. In some instances, the bispecific mini-antibody comprises divalent Fab$_2$, F(ab)'$_3$ fragments, bis-scFv, (scFv)$_2$, diabody, minibody, triabody, tetrabody or a bi-specific T-cell engager (BiTE). In some embodiments, the bi-specific T-cell engager is a fusion protein that contains two single-chain variable fragments (scFvs) in which the two scFvs target epitopes of two different antigens. Exemplary bispecific mini-antibodies include, but are not limited to, DART (dual-affinity re-targeting platform; MacroGenics), blinatumomab (MT103 or AMG103; which targets CD19/CD3; Micromet), MT111 (targets CEA/CD3; Micromet/Amegen), MTI 12 (BAY2010112; targets PSMA/CD3; Micromet/Bayer), MT110 (AMG110; targets EPCAM/CD3; Amgen/Micromet), MGD006 (targets CD123/CD3; MacroGenics), MGD007 (targets GPA33/CD3; MacroGenics), BI1034020 (targets two different epitopes on β-amyloid; Ablynx), ALX0761 (targets IL17A/IL17F; Ablynx), TF2 (targets CEA/hepten; Immunomedics), IL-17/IL-34 biAb (BMS), AFM13 (targets CD30/CD16; Affimed), AFM11 (targets CD19/CD3; Affimed), and domain antibodies (dAbs from Domantis/GSK).

In some embodiments, the binding moiety A is a bispecific mini-antibody. In some instances, A is a bispecific Fab$_2$. In some instances, A is a bispecific F(ab)'$_3$ fragment. In some cases, A is a bispecific bis-scFv. In some cases, A is a bispecific (scFv)$_2$. In some embodiments, A is a bispecific diabody. In some embodiments, A is a bispecific minibody. In some embodiments, A is a bispecific triabody. In other embodiments, A is a bispecific tetrabody. In other embodiments, A is a bi-specific T-cell engager (BiTE). In additional embodiments, A is a bispecific mini-antibody selected from: DART (dual-affinity re-targeting platform; MacroGenics), blinatumomab (MT103 or AMG103; which targets CD19/CD3; Micromet), MT111 (targets CEA/CD3; Micromet/Amegen), MT112 (BAY2010112; targets PSMA/CD3; Micromet/Bayer), MT110 (AMG 110; targets EPCAM/CD3; Amgen/Micromet), MGD006 (targets CD123/CD3; MacroGenics), MGD007 (targets GPA33/CD3; MacroGenics), BI1034020 (targets two different epitopes on β-amyloid; Ablynx), ALX0761 (targets IL17A/IL17F; Ablynx), TF2 (targets CEA/hepten; Immunomedics), IL-17/IL-34 biAb (BMS), AFM13 (targets CD30/CD16; Affimed), AFM11 (targets CD19/CD3; Affimed), and domain antibodies (dAbs from Domantis/GSK).

In some embodiments, the binding moiety A is a trispecific antibody. In some instances, the trispecific antibody comprises F(ab)'$_3$ fragments or a triabody. In some instances, A is a trispecific F(ab)'$_3$ fragment. In some cases, A is a triabody. In some embodiments, A is a trispecific antibody as described in Dimas, et al., "Development of a trispecific antibody designed to simultaneously and efficiently target three different antigens on tumor cells," *Mol. Pharmaceutics*, 12(9): 3490-3501 (2015).

In some embodiments, the binding moiety A is an antibody or binding fragment thereof that recognizes a cell surface protein. In some instances, the cell surface protein is an antigen expressed by a cancerous cell. Exemplary cancer antigens include, but are not limited to, alpha fetoprotein, ASLG659, B7-H3, BAFF-R, Brevican, CA125 (MUC16), CA15-3, CA19-9, carcinoembryonic antigen (CEA), CA242, CRIPTO (CR, CR1, CRGF, CRIPTO, TDGF1, teratocarcinoma-derived growth factor), CTLA-4, CXCR5, E16 (LAT1, SLC7A5), FcRH2 (IFGP4, IRTA4, SPAP1A (SH2 domain containing phosphatase anchor protein 1a), SPAP1B, SPAP1C), epidermal growth factor, ETBR, Fc receptor-like protein 1 (FCRH1), GEDA, HLA-DOB (Beta subunit of MHC class II molecule (Ia antigen), human chorionic gonadotropin, ICOS, IL-2 receptor, IL20Ra, Immunoglobulin superfamily receptor translocation associated 2 (IRTA2), L6, Lewis Y, Lewis X, MAGE-1, MAGE-2, MAGE-3, MAGE 4, MART1, mesothelin, MDP, MPF (SMR, MSLN), MCP1 (CCL2), macrophage inhibitory factor (MIF), MPG, MSG783, mucin, MUC1-KLH, Napi3b (SLC34A2), nectin-4, Neu oncogene product, NCA, placental alkaline phosphatase, prostate specific membrane antigen (PMSA), prostatic acid phosphatase, PSCA h1g, p97, Purinergic receptor P2X ligand-gated ion channel 5 (P2X5), LY64 (Lymphocyte antigen 64 (RP105), gp100, P21, six transmembrane epithelial antigen of prostate (STEAP1), STEAP2, Sema 5b, tumor-associated glycoprotein 72 (TAG-72), transferrin receptor, TrpM4 (BR22450, FLJ20041, TRPM4, TRPM4B, transient receptor potential cation channel, subfamily M, member 4) and the like. In some instances, the binding moiety is an α-transferrin receptor antibody or binding fragments thereof. In some instances, the binding moiety is an α-human transferrin receptor antibody. In some instances, the binding moiety is an α-human transferrin receptor antibody as described in PCT/US2019/068078, which is incorporated by reference herein.

In some instances, the cell surface protein comprises clusters of differentiation (CD) cell surface markers. Exemplary CD cell surface markers include, but are not limited to, CD1, CD2, CD3, CD4, CD5, CD6, CD7, CD8, CD9, CD10, CD11a, CD11b, CD11c, CD11 d, CDw12, CD13, CD14, CD15, CD15s, CD16, CDw17, CD18, CD19, CD20, CD21, CD22, CD23, CD24, CD25, CD26, CD27, CD28, CD29, CD30, CD31, CD32, CD33, CD34, CD35, CD36, CD37, CD38, CD39, CD40, CD41, CD42, CD43, CD44, CD45, CD45RO, CD45RA, CD45RB, CD46, CD47, CD48, CD49a, CD49b, CD49c, CD49d, CD49e, CD49f, CD50, CD51, CD52, CD53, CD54, CD55, CD56, CD57, CD58, CD59, CDw60, CD61, CD62E, CD62L (L-selectin), CD62P, CD63, CD64, CD65, CD66a, CD66b, CD66c, CD66d, CD66e, CD71, CD79 (e.g., CD79a, CD79b), CD90, CD95 (Fas), CD103, CD104, CD125 (IL5RA), CD134 (OX40), CD137 (4-1BB), CD152 (CTLA-4), CD221, CD274, CD279 (PD-1), CD319 (SLAMF7), CD326 (Ep-CAM), and the like.

In some instances, the binding moiety A is an antibody or binding fragment thereof that recognizes a cancer antigen. In some instances, the binding moiety A is an antibody or binding fragment thereof that recognizes alpha fetoprotein, ASLG659, B7-H3, BAFF-R, Brevican, CA125 (MUC16), CA15-3, CA19-9, carcinoembryonic antigen (CEA), CA242, CRIPTO (CR, CR1, CRGF, CRIPTO, TDGF1, teratocarcinoma-derived growth factor), CTLA-4, CXCR5, E16 (LAT1, SLC7A5), FcRH2 (IFGP4, IRTA4, SPAP1A (SH2 domain containing phosphatase anchor protein 1a), SPAP1B, SPAPiC), epidermal growth factor, ETBR, Fc receptor-like protein 1 (FCRH1), GEDA, HLA-DOB (Beta subunit of MHC class II molecule (Ia antigen), human chorionic gonadotropin, ICOS, IL-2 receptor, IL20Rα, Immunoglobulin superfamily receptor translocation associated 2 (IRTA2), L6, Lewis Y, Lewis X, MAGE-1, MAGE-2, MAGE-3, MAGE 4, MART1, mesothelin, MCP1 (CCL2), MDP, macrophage inhibitory factor (MIF), MPF (SMR, MSLN), MPG, MSG783, mucin, MUC1-KLH, Napi3b (SLC34A2), nectin-4, Neu oncogene product, NCA, placental alkaline phosphatase, prostate specific membrane antigen (PMSA), prostatic acid phosphatase, PSCA h1g, p97, Purinergic receptor P2X ligand-gated ion channel 5 (P2X5), LY64 (Lymphocyte antigen 64 (RP105), gp100, P21, six transmembrane epithelial antigen of prostate (STEAP1), STEAP2, Sema 5b, tumor-associated glycoprotein 72 (TAG-72), TrpM4 (BR22450, FLJ20041, TRPM4, TRPM4B, transient receptor potential cation channel, subfamily M, member 4) or a combination thereof.

In some instances, the binding moiety A is an antibody or binding fragment thereof that recognizes a CD cell surface marker. In some instances, the binding moiety A is an antibody or binding fragment thereof that recognizes CD1, CD2, CD3, CD4, CD5, CD6, CD7, CD8, CD9, CD10, CD11a, CD11b, CD11c, CD11d, CDw12, CD13, CD14, CD15, CD15s, CD16, CDw17, CD18, CD19, CD20, CD21, CD22, CD23, CD24, CD25, CD26, CD27, CD28, CD29, CD30, CD31, CD32, CD33, CD34, CD35, CD36, CD37, CD38, CD39, CD40, CD41, CD42, CD43, CD44, CD45, CD45RO, CD45RA, CD45RB, CD46, CD47, CD48, CD49a, CD49b, CD49c, CD49d, CD49e, CD49f, CD50, CD51, CD52, CD53, CD54, CD55, CD56, CD57, CD58, CD59, CDw60, CD61, CD62E, CD62L (L-selectin), CD62P, CD63, CD64, CD65, CD66a, CD66b, CD66c, CD66d, CD66e, CD71, CD79 (e.g., CD79a, CD79b), CD90, CD95 (Fas), CD103, CD104, CD125 (IL5RA), CD134 (OX40), CD137 (4-1BB), CD152 (CTLA-4), CD221, CD274, CD279 (PD-1), CD319 (SLAMF7), CD326 (Ep-CAM), or a combination thereof.

In some embodiments, the antibody or binding fragment thereof comprises zalutumumab (HuMax-EFGr, Genmab), abagovomab (Menarini), abituzumab (Merck), adecatumumab (MT201), alacizumab pegol, alemtuzumab (Campath®, MabCampath, or Campath-1H; Leukosite), AlloMune (BioTransplant), amatuximab (Morphotek, Inc.), anti-VEGF (Genetech), anatumomab mafenatox, apolizumab (hu1D10), ascrinvacumab (Pfizer Inc.), atezolizumab (MPDL3280A; Genentech/Roche), B43.13 (OvaRex, AltaRex Corporation), basiliximab (Simulect®, Novartis), belimumab (Benlysta®, GlaxoSmithKline), bevacizumab (Avastin®, Genentech), blinatumomab (Blincyto, AMG103; Amgen), BEC2 (ImGlone Systems Inc.), carlumab (Janssen Biotech), catumaxomab (Removab, Trion Pharma), CEAcide (Immunomedics), Cetuximab (Erbitux®, ImClone), citatuzumab bogatox (VB6-845), cixutumumab (IMC-A12, ImClone Systems Inc.), conatumumab (AMG 655, Amgen), dacetuzumab (SGN-40, huS2C6; Seattle Genetics, Inc.), daratumumab (Darzalex®, Janssen Biotech), detumomab, drozitumab (Genentech), durvalumab (MedImmune), dusigitumab (MedImmune), edrecolomab (MAb17-1A, Panorex, Glaxo Wellcome), elotuzumab (Empliciti™, Bristol-Myers Squibb), emibetuzumab (Eli Lilly), enavatuzumab (Facet Biotech Corp.), enfortumab vedotin (Seattle Genetics, Inc.), enoblituzumab (MGA271, MacroGenics, Inc.), ensituximab (Neogenix Oncology, Inc.), epratuzumab (LymphoCide, Immunomedics, Inc.), ertumaxomab (Rexomun®, Trion Pharma), etaracizumab (Abegrin, MedImmune), farletuzumab (MORAb-003, Morphotek, Inc), FBTA05 (Lymphomun, Trion Pharma), ficlatuzumab (AVEO Pharmaceuticals), figitumumab (CP-751871, Pfizer), flanvotumab (ImClone Systems), fresolimumab (GC1008, Aanofi-Aventis), futuximab, glaximab, ganitumab (Amgen), girentuximab (Rencarex®, Wilex AG), IMAB362 (Claudiximab, Ganymed Pharmaceuticals AG), imalumab (Baxalta), IMC-1C11 (ImClone Systems), IMC-C225 (Imclone Systems Inc.), imgatuzumab (Genentech/Roche), intetumumab (Centocor, Inc.), ipilimumab (Yervoy®, Bristol-Myers Squibb), iratumumab (Medarex, Inc.), isatuximab (SAR650984, Sanofi-Aventis), labetuzumab (CEA-CIDE, Immunomedics), lexatumumab (ETR2-ST01, Cambridge Antibody Technology), lintuzumab (SGN-33, Seattle Genetics), lucatumumab (Novartis), lumiliximab, mapatumumab (HGS-ETR1, Human Genome Sciences), matuzumab (EMD 72000, Merck), milatuzumab (hLL1, Immunomedics, Inc.), mitumomab (BEC-2, ImClone Systems), narnatumab (ImClone Systems), necitumumab (Portrazza™, Eli Lilly), nesvacumab (Regeneron Pharmaceuticals), nimotuzumab (h-R3, BIOMAb EGFR, TheraCIM, Theraloc, or CIMAher; Biotech Pharmaceutical Co.), nivolumab (Opdivo®, Bristol-Myers Squibb), obinutuzumab (Gazyva or Gazyvaro; Hoffmann-La Roche), ocaratuzumab (AME-133v, LY2469298; Mentrik Biotech, LLC), ofatumumab (Arzerra®, Genmab), onartuzumab (Genentech), Ontuxizumab (Morphotek, Inc.), oregovomab (OvaRex®, AltaRex Corp.), otlertuzumab (Emergent BioSolutions), panitumumab (ABX-EGF, Amgen), pankomab (Glycotope GMBH), parsatuzumab (Genentech), patritumab, pembrolizumab (Keytruda®, Merck), pemtumomab (Theragyn, Antisoma), pertuzumab (Perjeta, Genentech), pidilizumab (CT-011, Medivation), polatuzumab vedotin (Genentech/Roche), pritumumab, racotumomab (Vaxira®, Recombio), ramucirumab (Cyramza®, ImClone Systems Inc.), rituximab (Rituxan®, Genentech), robatumumab (Schering-Plough), Seribantumab (Sanofi/Merrimack Pharmaceuticals, Inc.), sibrotuzumab, siltuximab (Sylvant™, Janssen Biotech), Smart MI95 (Protein Design Labs, Inc.), Smart ID10 (Protein Design Labs, Inc.), tabalumab (LY2127399, Eli Lilly), taplitumomab paptox, tenatumomab, teprotumumab (Roche), tetulomab, TGN1412 (CD28-SuperMAB or TAB08), tigatuzumab (CD-1008, Daiichi Sankyo), tositumomab, trastuzumab (Herceptin®), tremelimumab (CP-672,206; Pfizer), tucotuzumab celmoleukin (EMD Pharmaceuticals), ublituximab, urelumab (BMS-663513, Bristol-Myers Squibb), voloximab (M200, Biogen Idec), zatuximab, and the like.

In some embodiments, the binding moiety A comprises zalutumumab (HuMax-EFGr, Genmab), abagovomab (Menarini), abituzumab (Merck), adecatumumab (MT201), alacizumab pegol, alemtuzumab (Campath®, MabCampath, or Campath-1H; Leukosite), AlloMune (BioTransplant), amatuximab (Morphotek, Inc.), anti-VEGF (Genetech), anatumomab mafenatox, apolizumab (hu1D10), ascrinvacumab (Pfizer Inc.), atezolizumab (MPDL3280A; Genentech/Roche), B43.13 (OvaRex, AltaRex Corporation), basiliximab (Simulect®, Novartis), belimumab (Benlysta®, GlaxoSmithKline), bevacizumab (Avastin®, Genentech), blinatumomab (Blincyto, AMG103; Amgen), BEC2 (ImGlone Systems Inc.), carlumab (Janssen Biotech), catumaxomab (Removab, Trion Pharma), CEAcide (Immunomedics), Cetuximab (Erbitux®, ImClone), citatuzumab bogatox (VB6-845), cixutumumab (IMC-A12, ImClone Systems Inc.), conatumumab (AMG 655, Amgen), dacetuzumab (SGN-40, huS2C6; Seattle Genetics, Inc.), daratumumab (Darzalex®, Janssen Biotech), detumomab, drozitumab (Genentech), durvalumab (MedImmune), dusigitumab (MedImmune), edrecolomab (MAb17-1A, Panorex, Glaxo Wellcome), elotuzumab (Empliciti™, Bristol-Myers Squibb), emibetuzumab (Eli Lilly), enavatuzumab (Facet Biotech Corp.), enfortumab vedotin (Seattle Genetics, Inc.), enoblituzumab (MGA271, MacroGenics, Inc.), ensituximab (Neogenix Oncology, Inc.), epratuzumab (LymphoCide, Immunomedics, Inc.), ertumaxomab (Rexomun®, Trion Pharma), etaracizumab (Abegrin, MedImmune), farletuzumab (MORAb-003, Morphotek, Inc), FBTA05 (Lymphomun, Trion Pharma), ficlatuzumab (AVEO Pharmaceuticals), figitumumab (CP-751871, Pfizer), flanvotumab (ImClone Systems), fresolimumab (GC1008, Aanofi-Aventis), futuximab, glaximab, ganitumab (Amgen), girentuximab (Rencarex®, Wilex AG), IMAB362 (Claudiximab, Ganymed Pharmaceuticals AG), imalumab (Baxalta), IMC-1C11 (ImClone Systems), IMC-C225 (Imclone Systems Inc.), imgatuzumab (Genentech/Roche), intetumumab (Centocor, Inc.), ipilimumab (Yervoy®, Bristol-Myers Squibb), iratumumab (Medarex, Inc.), isatuximab (SAR650984, Sanofi-Aventis), labetuzumab (CEA-CIDE, Immunomedics), lexatumumab (ETR2-ST01, Cambridge Antibody Technology), lintuzumab (SGN-33, Seattle Genetics), lucatumumab (Novartis), lumiliximab, mapatumumab (HGS-ETR1, Human Genome Sciences), matuzumab (EMD 72000, Merck), milatuzumab (hLL1, Immunomedics, Inc.), mitumomab (BEC-2, ImClone Systems), narnatumab (ImClone Systems), necitumumab (Portrazza™, Eli Lilly), nesvacumab (Regeneron Pharmaceuticals), nimotuzumab (h-R3, BIOMAb EGFR, TheraCIM, Theraloc, or CIMAher; Biotech Pharmaceutical Co.), nivolumab (Opdivo®, Bristol-Myers Squibb), obinutuzumab (Gazyva or Gazyvaro; Hoffmann-La Roche), ocaratuzumab (AME-133v, LY2469298; Mentrik Biotech, LLC), ofatumumab (Arzerra®, Genmab), onartuzumab (Genentech), Ontuxizumab (Morphotek, Inc.), oregovomab (OvaRex®, AltaRex Corp.), otlertuzumab (Emergent BioSolutions), panitumumab (ABX-EGF, Amgen), pankomab (Glycotope GMBH), parsatuzumab (Genentech), patritumab, pembrolizumab (Keytruda®, Merck), pemtumomab (Theragyn, Antisoma), pertuzumab (Perjeta, Genentech), pidilizumab (CT-011, Medivation), polatuzumab vedotin (Genentech/Roche), pritumumab, racotumomab (Vaxira®, Recombio), ramucirumab (Cyramza®, ImClone Systems Inc.), rituximab (Rituxan®, Genentech), robatumumab (Schering-Plough), Seribantumab (Sanofi/Merrimack Pharmaceuticals, Inc.), sibrotuzumab, siltuximab (Sylvant™, Janssen Biotech), Smart MI95 (Protein Design Labs, Inc.), Smart ID10 (Protein Design Labs, Inc.), tabalumab (LY2127399, Eli Lilly), taplitumomab paptox, tenatumomab, teprotumumab (Roche), tetulomab, TGN1412 (CD28-SuperMAB or TAB08), tigatuzumab (CD-1008, Daiichi Sankyo), tositumomab, trastuzumab (Herceptin®), tremelimumab (CP-672,206; Pfizer), tucotuzumab celmoleukin (EMD Pharmaceuticals), ublituximab, urelumab (BMS-663513, Bristol-Myers Squibb), volociximab (M200, Biogen Idec), or zatuximab. In some embodiments, the binding moiety A is zalutumumab (HuMax-EFGr, by Genmab).

Additional Binding Moieties

In some embodiments, the binding moiety is a plasma protein. In some instances, the plasma protein comprises albumin. In some instances, the binding moiety A is albumin. In some instances, albumin is conjugated by one or more of a conjugation chemistry described herein to a polynucleic acid molecule. In some instances, albumin is conjugated by native ligation chemistry to a polynucleic acid molecule. In some instances, albumin is conjugated by lysine conjugation to a polynucleic acid molecule.

In some instances, the binding moiety is a steroid. Exemplary steroids include cholesterol, phospholipids, di- and triacylglycerols, fatty acids, hydrocarbons that are saturated, unsaturated, comprise substitutions, or combinations thereof. In some instances, the steroid is cholesterol. In some instances, the binding moiety is cholesterol. In some instances, cholesterol is conjugated by one or more of a conjugation chemistry described herein to a polynucleic acid molecule. In some instances, cholesterol is conjugated by native ligation chemistry to a polynucleic acid molecule. In some instances, cholesterol is conjugated by lysine conjugation to a polynucleic acid molecule.

In some instances, the binding moiety is a polymer, including but not limited to poly nucleic acid molecule aptamers that bind to specific surface markers on cells. In this instance the binding moiety is a polynucleic acid that does not hybridize to a target gene or mRNA, but instead is capable of selectively binding to a cell surface marker similarly to an antibody binding to its specific epitope of a cell surface marker.

In some cases, the binding moiety is a peptide. In some cases, the peptide comprises between about 1 and about 3 kDa. In some cases, the peptide comprises between about 1.2 and about 2.8 kDa, about 1.5 and about 2.5 kDa, or about 1.5 and about 2 kDa. In some instances, the peptide is a bicyclic peptide. In some cases, the bicyclic peptide is a constrained bicyclic peptide. In some instances, the binding moiety is a bicyclic peptide (e.g., bicycles from Bicycle Therapeutics).

In additional cases, the binding moiety is a small molecule. In some instances, the small molecule is an antibody-recruiting small molecule. In some cases, the antibody-recruiting small molecule comprises a target-binding terminus and an antibody-binding terminus, in which the target-binding terminus is capable of recognizing and interacting with a cell surface receptor. For example, in some instances, the target-binding terminus comprising a glutamate urea compound enables interaction with PSMA, thereby, enhances an antibody interaction with a cell (e.g., a cancerous cell) that expresses PSMA. In some instances, a binding moiety is a small molecule described in Zhang et al., "A remote arene-binding site on prostate specific membrane antigen revealed by antibody-recruiting small molecules," J Am Chem Soc. 132(36): 12711-12716 (2010); or McEnaney, et al., "Antibody-recruiting molecules: an emerging paradigm for engaging immune function in treating human disease," ACS Chem Biol. 7(7): 1139-1151 (2012).

Polynucleic Acid Molecule Targets

In some embodiments, the polynucleic acid molecule B is a polynucleic acid molecule (or polynucleotide) that hybridizes to a target region on an oncogene. In some instances, oncogenes are further classified into several categories: growth factors or mitogens, receptor tyrosine kinases, cytoplasmic tyrosine kinases, cytoplasmic serine/threonine kinases, regulatory GTPases, and transcription factors. Exemplary growth factors include c-Sis. Exemplary receptor tyrosine kinases include epidermal growth factor receptor (EGFR), platelet-derived growth factor receptor (PDGFR), vascular endothelial growth factor receptor (VEGFR), and HER2/neu. Exemplary cytoplasmic tyrosine kinases include Src-family tyrosine kinases, Syk-ZAP-70 family of tyrosine kinases, BTK family of tyrosine kinases, and Ab1 gene in CML. Exemplary cytoplasmic serine/threonine kinases include Raf kinase and cyclin-dependent kinases. Exemplary regulatory GTPases include Ras family of proteins such as KRAS. Exemplary transcription factors include MYC gene. In some instances, an oncogene described herein comprises an oncogene selected from growth factors or mitogens, receptor tyrosine kinases, cytoplasmic tyrosine kinases, cytoplasmic serine/threonine kinases, regulatory GTPases, or transcription factors. In some embodiments, the polynucleic acid molecule is a polynucleic acid molecule that hybridizes to a target region of an oncogene selected from growth factors or mitogens, receptor tyrosine kinases, cytoplasmic tyrosine kinases, cytoplasmic serine/threonine kinases, regulatory GTPases, or transcription factors.

In some embodiments, an oncogene described herein comprises Abl, AKT-2, ALK, AMLI (or RUNXI), AR, AXL, BCL-2, 3, 6, BRAF, c-MYC, EGFR, ErbB-2 (Her2, Neu), Fms, FOS, GLI1, HPRT1, IL-3, INTS2, JUN, KIT, KS3, K-sam, LBC (AKAP13), LCK, LMO1, LMO2, LYL1, MAS1, MDM2, MET, MLL (KMT2A), MOS, MYB, MYH11/CBFB, NOTCH1 (TAN1), NTRK1 (TRK), OST (SLC51B), PAX5, PIM1, PRAD-1, RAF, RAR/PML, HRAS, KRAS, NRAS, REL/NRG, RET, ROS, SKI, SRC, TIAM1, or TSC2. In some embodiments, the polynucleic acid molecule is a polynucleic acid molecule that hybridizes to a target region of Ab1, AKT-2, ALK, AMLI (or RUNXI), AR, AXL, BCL-2, 3, 6, BRAF, c-MYC, EGFR, ErbB-2 (Her2, Neu), Fms, FOS, GLI1, HPRT1, IL-3, INTS2, JUN, KIT, KS3, K-sam, LBC (AKAP13), LCK, LMO1, LMO2, LYL1, MAS1, MDM2, MET, MLL (KMT2A), MOS, MYB, MYH11/CBFB, NOTCH1 (TAN1), NTRK1 (TRK), OST (SLC51B), PAX5, PIM1, PRAD-1, RAF, RAR/PML, HRAS, KRAS, NRAS, REL/NRG, RET, ROS, SKI, SRC, TIAM1, or TSC2.

In some embodiments, an oncogene described herein comprises KRAS, EGFR, AR, HPRT1, CNNTB1 (β-catenin), or β-catenin associated genes. In some embodiments, the polynucleic acid molecule B is a polynucleic acid molecule that hybridizes to a target region of KRAS, EGFR, AR, HPRT1, CNNTB1 (β-catenin), or β-catenin associated genes. In some embodiments, the polynucleic acid molecule B is a polynucleic acid molecule that hybridizes to a target region of KRAS. In some embodiments, the polynucleic acid molecule B is a polynucleic acid molecule that hybridizes to a target region of EGFR. In some embodiments, the polynucleic acid molecule B is a polynucleic acid molecule that hybridizes to a target region of AR. In some embodiments, the polynucleic acid molecule B is a polynucleic acid molecule that hybridizes to a target region of CNNTB1 (p3-catenin). In some embodiments, the polynucleic acid molecule B is a polynucleic acid molecule that hybridizes to a target region of CNNTB1 (β-catenin) associated genes. In some instances, the β-catenin associated genes comprise PIK3CA, PIK3CB, and Myc. In some instances, the polynucleic acid molecule B is a polynucleic acid molecule that hybridizes to a target region of HPRT1.

In some embodiments, the binding moiety A is conjugated according to Formula (I) to a polynucleic acid molecule (B), and optionally a polymer (C), described herein. In some embodiments, the polynucleic acid molecule comprises a sequence having at least 50%, 55%, 60%, 65%, 70%, 75%, 80%, 85%, 90%, 95%, 96%, 97%, 98%, 99%, or 100% sequence identity to SEQ ID NOs:142-255. 256-369, 481-591, 592-702, 3407-14222, 14222-14238, or 14239-14352. In some instances, the polynucleic acid molecule comprises a sequence selected from SEQ ID NOs: 142-255. 256-369, 481-591, 592-702, 3407-14222, 14222-14238, or 14239-14352. In some instances, the polymer C optionally comprises polyalkylene oxide (e.g., polyethylene glycol).

In some embodiments, the binding moiety A is conjugated to a polynucleic acid molecule (B), and optionally a polymer (C). In some instances, the binding moiety A is an antibody or binding fragment thereof.

In some embodiments, the binding moiety A is conjugated to a polynucleic acid molecule (B) non-specifically. In some instances, the binding moiety A is conjugated to a polynucleic acid molecule (B) via a lysine residue or a cysteine residue, in a non-site specific manner. In some instances, the binding moiety A is conjugated to a polynucleic acid molecule (B) via a lysine residue in a non-site specific manner. In some cases, the binding moiety A is conjugated to a polynucleic acid molecule (B) via a cysteine residue in a non-site specific manner. In some instances, the binding moiety A is an antibody or binding fragment thereof.

In some embodiments, the binding moiety A is conjugated to a polynucleic acid molecule (B) in a site-specific manner. In some instances, the binding moiety A is conjugated to a polynucleic acid molecule (B) through a lysine residue, a cysteine residue, at the 5'-terminus, at the 3'-terminus, an unnatural amino acid, or an enzyme-modified or enzyme-catalyzed residue, via a site-specific manner. In some instances, the binding moiety A is conjugated to a polynucleic acid molecule (B) through a lysine residue via a site-specific manner. In some instances, the binding moiety A is conjugated to a polynucleic acid molecule (B) through a cysteine residue via a site-specific manner. In some instances, the binding moiety A is conjugated to a polynucleic acid molecule (B) at the 5'-terminus via a site-specific manner. In some instances, the binding moiety A is conjugated to a polynucleic acid molecule (B) at the 3'-terminus via a site-specific manner. In some instances, the binding moiety A is conjugated to a polynucleic acid molecule (B) through an unnatural amino acid via a site-specific manner. In some instances, the binding moiety A is conjugated to a polynucleic acid molecule (B) through an enzyme-modified or enzyme-catalyzed residue via a site-specific manner. In some instances, the binding moiety A is an antibody or binding fragment thereof.

In some embodiments, one or more regions of a binding moiety A (e.g., an antibody or binding fragment thereof) is conjugated to a polynucleic acid molecule (B). In some instances, the one or more regions of a binding moiety A comprise the N-terminus, the C-terminus, in the constant region, at the hinge region, or the Fc region of the binding moiety A. In some instances, the polynucleic acid molecule (B) is conjugated to the N-terminus of the binding moiety A (e.g., the N-terminus of an antibody or binding fragment thereof). In some instances, the polynucleic acid molecule (B) is conjugated to the C-terminus of the binding moiety A (e.g., the N-terminus of an antibody or binding fragment thereof). In some instances, the polynucleic acid molecule (B) is conjugated to the constant region of the binding moiety A (e.g., the constant region of an antibody or binding fragment thereof). In some instances, the polynucleic acid molecule (B) is conjugated to the hinge region of the binding moiety A (e.g., the constant region of an antibody or binding fragment thereof). In some instances, the polynucleic acid molecule (B) is conjugated to the Fc region of the binding moiety A (e.g., the constant region of an antibody or binding fragment thereof).

In some embodiments, one or more polynucleic acid molecule (B) is conjugated to a binding moiety A. In some instances, about 1, 2, 3, 4, 5, 6, 7, 8, 9, 10, 11, 12, 13, 14, 15, 16, or more polynucleic acid molecules are conjugated to one binding moiety A. In some instances, about 1 polynucleic acid molecule is conjugated to one binding moiety A. In some instances, about 2 polynucleic acid molecules are conjugated to one binding moiety A. In some instances, about 3 polynucleic acid molecules are conjugated to one binding moiety A. In some instances, about 4 polynucleic acid molecules are conjugated to one binding moiety A. In some instances, about 5 polynucleic acid molecules are conjugated to one binding moiety A. In some instances, about 6 polynucleic acid molecules are conjugated to one binding moiety A. In some instances, about 7 polynucleic acid molecules are conjugated to one binding moiety A. In some instances, about 8 polynucleic acid molecules are conjugated to one binding moiety A. In some instances, about 9 polynucleic acid molecules are conjugated to one binding moiety A. In some instances, about 10 polynucleic acid molecules are conjugated to one binding moiety A. In some instances, about 11 polynucleic acid molecules are conjugated to one binding moiety A. In some instances, about 12 polynucleic acid molecules are conjugated to one binding moiety A. In some instances, about 13 polynucleic acid molecules are conjugated to one binding moiety A. In some instances, about 14 polynucleic acid molecules are conjugated to one binding moiety A. In some instances, about 15 polynucleic acid molecules are conjugated to one binding moiety A. In some instances, about 16 polynucleic acid molecules are conjugated to one binding moiety A. In some cases, the one or more polynucleic acid molecules are the same. In other cases, the one or more polynucleic acid molecules are different. In some instances, the binding moiety A is an antibody or binding fragment thereof.

In some embodiments, the number of polynucleic acid molecule (B) conjugated to a binding moiety A (e.g., an antibody or binding fragment thereof) forms a ratio. In some instances, the ratio is referred to as a DAR (drug-to-antibody) ratio, in which the drug as referred to herein is the polynucleic acid molecule (B). In some instances, the DAR ratio of the polynucleic acid molecule (B) to binding moiety A is about 1, 2, 3, 4, 5, 6, 7, 8, 9, 10, 11, 12, 13, 14, 15, 16, or greater. In some instances, the DAR ratio of the polynucleic acid molecule (B) to binding moiety A is about 1 or greater. In some instances, the DAR ratio of the polynucleic acid molecule (B) to binding moiety A is about 2 or greater. In some instances, the DAR ratio of the polynucleic acid molecule (B) to binding moiety A is about 3 or greater. In some instances, the DAR ratio of the polynucleic acid molecule (B) to binding moiety A is about 4 or greater. In some instances, the DAR ratio of the polynucleic acid molecule (B) to binding moiety A is about 5 or greater. In some instances, the DAR ratio of the polynucleic acid molecule (B) to binding moiety A is about 6 or greater. In some instances, the DAR ratio of the polynucleic acid molecule (B) to binding moiety A is about 7 or greater. In some instances, the DAR ratio of the polynucleic acid molecule (B) to binding moiety A is about 8 or greater. In some instances, the DAR ratio of the polynucleic acid molecule (B) to binding moiety A is about 9 or greater. In some instances, the DAR ratio of the polynucleic acid molecule (B) to binding moiety A is about 10 or greater. In some instances, the DAR ratio of the polynucleic acid molecule (B) to binding moiety A is about 11 or greater. In some instances, the DAR ratio of the polynucleic acid molecule (B) to binding moiety A is about 12 or greater.

In some instances, the DAR ratio of the polynucleic acid molecule (B) to binding moiety A (e.g., an antibody or binding fragment thereof) is about 1, 2, 3, 4, 5, 6, 7, 8, 9, 10, 11, 12, 13, 14, 15, or 16. In some instances, the DAR ratio of the polynucleic acid molecule (B) to binding moiety A is about 1. In some instances, the DAR ratio of the polynucleic acid molecule (B) to binding moiety A is about 2. In some instances, the DAR ratio of the polynucleic acid molecule (B) to binding moiety A is about 3. In some instances, the DAR ratio of the polynucleic acid molecule (B) to binding moiety A is about 4. In some instances, the DAR ratio of the polynucleic acid molecule (B) to binding moiety A is about 5. In some instances, the DAR ratio of the polynucleic acid molecule (B) to binding moiety A is about 6. In some instances, the DAR ratio of the polynucleic acid molecule (B) to binding moiety A is about 7. In some instances, the DAR ratio of the polynucleic acid molecule (B) to binding moiety A is about 8. In some instances, the DAR ratio of the polynucleic acid molecule (B) to binding moiety A is about 9. In some instances, the DAR ratio of the polynucleic acid molecule (B) to binding moiety A is about 10. In some instances, the DAR ratio of the polynucleic acid molecule (B) to binding moiety A is about 11. In some instances, the DAR ratio of the polynucleic acid molecule (B) to binding moiety A is about 12. In some instances, the DAR ratio of the polynucleic acid molecule (B) to binding moiety A is about 13. In some instances, the DAR ratio of the polynucleic acid molecule (B) to binding moiety A is about 14. In some instances, the DAR ratio of the polynucleic acid molecule (B) to binding moiety A is about 15. In some instances, the DAR ratio of the polynucleic acid molecule (B) to binding moiety A is about 16.

In some instances, the DAR ratio of the polynucleic acid molecule (B) to binding moiety A is 1, 2, 3, 4, 5, 6, 7, 8, 9, 10, 11, 12, 13, 14, 15, or 16. In some instances, the DAR ratio of the polynucleic acid molecule (B) to binding moiety A is 1. In some instances, the DAR ratio of the polynucleic acid molecule (B) to binding moiety A is 2. In some instances, the DAR ratio of the polynucleic acid molecule (B) to binding moiety A is 4. In some instances, the DAR ratio of the polynucleic acid molecule (B) to binding moiety A is 6. In some instances, the DAR ratio of the polynucleic acid molecule (B) to binding moiety A is 8. In some instances, the DAR ratio of the polynucleic acid molecule (B) to binding moiety A is 12.

In some embodiments, an antibody or its binding fragment is further modified using conventional techniques known in the art, for example, by using amino acid deletion, insertion, substitution, addition, and/or by recombination and/or any other modification (e.g. posttranslational and chemical modifications, such as glycosylation and phosphorylation) known in the art either alone or in combination. In some instances, the modification further comprises a modification for modulating interaction with Fc receptors. In some instances, the one or more modifications include those described in, for example, International Publication No. WO97/34631, which discloses amino acid residues involved in the interaction between the Fc domain and the FcRn receptor. Methods for introducing such modifications in the nucleic acid sequence underlying the amino acid sequence of an antibody or its binding fragment is well known to the person skilled in the art.

In some instances, an antibody binding fragment further encompasses its derivatives and includes polypeptide sequences containing at least one CDR.

In some instances, the term "single-chain" as used herein means that the first and second domains of a bi-specific single chain construct are covalently linked, preferably in the form of a co-linear amino acid sequence encodable by a single nucleic acid molecule.

In some instances, a bispecific single chain antibody construct relates to a construct comprising two antibody derived binding domains. In such embodiments, bi-specific single chain antibody construct is tandem bi-scFv or diabody. In some instances, a scFv contains a VH and VL domain connected by a linker peptide. In some instances, linkers are of a length and sequence sufficient to ensure that each of the first and second domains can, independently from one another, retain their differential binding specificities.

In some embodiments, binding to or interacting with as used herein defines a binding/interaction of at least two antigen-interaction-sites with each other. In some instances, antigen-interaction-site defines a motif of a polypeptide that shows the capacity of specific interaction with a specific antigen or a specific group of antigens. In some cases, the binding/interaction is also understood to define a specific recognition. In such cases, specific recognition refers to that the antibody or its binding fragment is capable of specifically interacting with and/or binding to at least two amino acids of each of a target molecule. For example, specific recognition relates to the specificity of the antibody molecule, or to its ability to discriminate between the specific regions of a target molecule. In additional instances, the specific interaction of the antigen-interaction-site with its specific antigen results in an initiation of a signal, e.g. due to the induction of a change of the conformation of the antigen, an oligomerization of the antigen, etc. In further embodiments, the binding is exemplified by the specificity of a "key-lock-principle". Thus in some instances, specific motifs in the amino acid sequence of the antigen-interaction-site and the antigen bind to each other as a result of their primary, secondary or tertiary structure as well as the result of secondary modifications of said structure. In such cases, the specific interaction of the antigen-interaction-site with its specific antigen results as well in a simple binding of the site to the antigen.

In some instances, specific interaction further refers to a reduced cross-reactivity of the antibody or its binding fragment or a reduced off-target effect. For example, the antibody or its binding fragment that bind to the polypeptide/protein of interest but do not or do not essentially bind to any of the other polypeptides are considered as specific for the polypeptide/protein of interest. Examples for the specific interaction of an antigen-interaction-site with a specific antigen comprise the specificity of a ligand for its receptor, for example, the interaction of an antigenic determinant (epitope) with the antigenic binding site of an antibody.

Production of Antibodies or Binding Fragments Thereof

In some embodiments, polypeptides described herein (e.g., antibodies and its binding fragments) are produced using any method known in the art to be useful for the synthesis of polypeptides (e.g., antibodies), in particular, by chemical synthesis or by recombinant expression, and are preferably produced by recombinant expression techniques.

In some instances, an antibody or its binding fragment thereof is expressed recombinantly, and the nucleic acid encoding the antibody or its binding fragment is assembled from chemically synthesized oligonucleotides (e.g., as described in Kutmeier et al., 1994, BioTechniques 17:242), which involves the synthesis of overlapping oligonucleotides containing portions of the sequence encoding the antibody, annealing and ligation of those oligonucleotides, and then amplification of the ligated oligonucleotides by PCR.

Alternatively, a nucleic acid molecule encoding an antibody is optionally generated from a suitable source (e.g., an antibody cDNA library, or cDNA library generated from any tissue or cells expressing the immunoglobulin) by PCR amplification using synthetic primers hybridizable to the 3' and 5' ends of the sequence or by cloning using an oligonucleotide probe specific for the particular gene sequence.

In some instances, an antibody or its binding is optionally generated by immunizing an animal, such as a rabbit, to generate polyclonal antibodies or, more preferably, by generating monoclonal antibodies, e.g., as described by Kohler and Milstein (1975, Nature 256:495-497) or, as described by Kozbor et al. (1983, Immunology Today 4:72) or Cole et al. (1985 in Monoclonal Antibodies and Cancer Therapy, Alan R. Liss, Inc., pp. 77-96). Alternatively, a clone encoding at least the Fab portion of the antibody is optionally obtained by screening Fab expression libraries (e.g., as described in Huse et al., 1989, Science 246:1275-1281) for clones of Fab fragments that bind the specific antigen or by screening antibody libraries (See, e.g., Clackson et al., 1991, Nature 352:624; Hane et al., 1997 Proc. Natl. Acad. Sci. USA 94:4937).

In some embodiments, techniques developed for the production of "chimeric antibodies" (Morrison et al., 1984, Proc. Natl. Acad. Sci. 81:851-855; Neuberger et al., 1984, Nature 312:604-608; Takeda et al., 1985, Nature 314:452-454) by splicing genes from a mouse antibody molecule of appropriate antigen specificity together with genes from a human antibody molecule of appropriate biological activity are used. A chimeric antibody is a molecule in which different portions are derived from different animal species, such as those having a variable region derived from a murine monoclonal antibody and a human immunoglobulin constant region, e.g., humanized antibodies.

In some embodiments, techniques described for the production of single chain antibodies (U.S. Pat. No. 4,694,778; Bird, 1988, Science 242:423-42; Huston et al., 1988, Proc. Natl. Acad. Sci. USA 85:5879-5883; and Ward et al., 1989, Nature 334:544-54) are adapted to produce single chain antibodies. Single chain antibodies are formed by linking the heavy and light chain fragments of the Fv region via an amino acid bridge, resulting in a single chain polypeptide. Techniques for the assembly of functional Fv fragments in E. coli are also optionally used (Skerra et al., 1988, Science 242:1038-1041).

In some embodiments, an expression vector comprising the nucleotide sequence of an antibody or the nucleotide sequence of an antibody is transferred to a host cell by conventional techniques (e.g., electroporation, liposomal transfection, and calcium phosphate precipitation), and the transfected cells are then cultured by conventional techniques to produce the antibody. In specific embodiments, the expression of the antibody is regulated by a constitutive, an inducible or a tissue, specific promoter.

In some embodiments, a variety of host-expression vector systems is utilized to express an antibody or its binding fragment described herein. Such host-expression systems represent vehicles by which the coding sequences of the antibody is produced and subsequently purified, but also represent cells that are, when transformed or transfected with the appropriate nucleotide coding sequences, express an antibody or its binding fragment in situ. These include, but are not limited to, microorganisms such as bacteria (e.g., E. coli and B. subtilis) transformed with recombinant bacteriophage DNA, plasmid DNA or cosmid DNA expression vectors containing an antibody or its binding fragment coding sequences; yeast (e.g., Saccharomyces Pichia) transformed with recombinant yeast expression vectors containing an antibody or its binding fragment coding sequences; insect cell systems infected with recombinant virus expression vectors (e.g., baculovirus) containing an antibody or its binding fragment coding sequences; plant cell systems infected with recombinant virus expression vectors (e.g., cauliflower mosaic virus (CaMV) and tobacco mosaic virus (TMV)) or transformed with recombinant plasmid expression vectors (e.g., Ti plasmid) containing an antibody or its binding fragment coding sequences; or mammalian cell systems (e.g., COS, CHO, BH, 293, 293T, 3T3 cells) harboring recombinant expression constructs containing promoters derived from the genome of mammalian cells (e.g., metallothionein promoter) or from mammalian viruses (e.g. the adenovirus late promoter; the vaccinia virus 7.5K promoter).

For long-term, high-yield production of recombinant proteins, stable expression is preferred. In some instances, cell lines that stably express an antibody are optionally engineered. Rather than using expression vectors that contain viral origins of replication, host cells are transformed with DNA controlled by appropriate expression control elements (e.g., promoter, enhancer, sequences, transcription terminators, polyadenylation sites, etc.), and a selectable marker. Following the introduction of the foreign DNA, engineered cells are then allowed to grow for 1-2 days in an enriched media, and then are switched to a selective media. The selectable marker in the recombinant plasmid confers resistance to the selection and allows cells to stably integrate the plasmid into their chromosomes and grow to form foci that in turn are cloned and expanded into cell lines. This method can advantageously be used to engineer cell lines which express the antibody or its binding fragments.

In some instances, a number of selection systems are used, including but not limited to the herpes simplex virus thymidine kinase (Wigler et al., 1977, *Cell* 11:223), hypoxanthine-guanine phosphoribosyltransferase (Szybalska & Szybalski, 192, *Proc. Natl. Acad. Sci. USA* 48:202), and adenine phosphoribosyltransferase (Lowy et al., 1980, *Cell* 22:817) genes are employed in tk-, hgprt- or aprt- cells, respectively. Also, antimetabolite resistance are used as the basis of selection for the following genes: dhfr, which confers resistance to methotrexate (Wigler et al., 1980, *Proc. Natl. Acad. Sci. USA* 77:357; O'Hare et al., 1981, *Proc. Natl. Acad. Sci. USA* 78:1527); gpt, which confers resistance to mycophenolic acid (Mulligan & Berg, 1981, *Proc. Natl. Acad. Sci. USA* 78:2072); neo, which confers resistance to the aminoglycoside G-418 (*Clinical Pharmacy* 12:488-505; Wu and Wu, 1991, *Biotherapy* 3:87-95; Tolstoshev, 1993, *Ann. Rev. Pharmacol. Toxicol.* 32:573-596; Mulligan, 1993, *Science* 260:926-932; and Morgan and Anderson, 1993, *Ann. Rev. Biochem.* 62:191-217; May, 1993, *TIB TECH* 11(5):155-215) and hygro, which confers resistance to hygromycin (Santerre et al., 1984, *Gene* 30:147). Methods commonly known in the art of recombinant DNA technology which can be used are described in Ausubel et al. (eds., 1993, *Current Protocols in Molecular Biology*, John Wiley & Sons, NY; Kriegler, 1990, *Gene Transfer and Expression, A Laboratory Manual*, Stockton Press, NY; and in Chapters 12 and 13, Dracopoli et al. (eds), 1994, *Current Protocols in Human Genetics*, John Wiley & Sons, NY.; Colberre-Garapin et al., 1981, *J. Mol. Biol.* 150:1).

In some instances, the expression levels of an antibody are increased by vector amplification (for a review, see Bebbington and Hentschel, *The use of vectors based on gene amplification for the expression of cloned genes in mammalian cells in DNA cloning*, Vol. 3. (Academic Press, New York, 1987)). When a marker in the vector system expressing an antibody is amplifiable, an increase in the level of inhibitor present in culture of host cell will increase the number of copies of the marker gene. Since the amplified region is associated with the nucleotide sequence of the antibody, production of the antibody will also increase (Crouse et al., 1983, *Mol. Cell Biol.* 3:257).

In some instances, any method known in the art for purification of an antibody is used, for example, by chromatography (e.g., ion exchange, affinity, particularly by affinity for the specific antigen after Protein A, and sizing column chromatography), centrifugation, differential solubility, or by any other standard technique for the purification of proteins.

Polymer Conjugating Moiety

In some embodiments, a polymer moiety C is further conjugated to a polynucleic acid molecule described herein, a binding moiety described herein, or in combinations thereof. In some instances, a polymer moiety C is conjugated a polynucleic acid molecule. In some cases, a polymer moiety C is conjugated to a binding moiety. In other cases, a polymer moiety C is conjugated to a polynucleic acid molecule-binding moiety molecule. In additional cases, a polymer moiety C is conjugated, and as discussed under the Therapeutic Molecule Platform section.

In some instances, the polymer moiety C is a natural or synthetic polymer, consisting of long chains of branched or unbranched monomers, and/or cross-linked network of monomers in two or three dimensions. In some instances, the polymer moiety C includes a polysaccharide, lignin, rubber, or polyalkylene oxide (e.g., polyethylene glycol). In some instances, the at least one polymer moiety C includes, but is not limited to, alpha-, omega-dihydroxylpolyethyleneglycol, biodegradable lactone-based polymer, e.g. polyacrylic acid, polylactide acid (PLA), poly(glycolic acid) (PGA), polypropylene, polystyrene, polyolefin, polyamide, polycyanoacrylate, polyimide, polyethylenterephthalat (PET, PETG), polyethylene terephthalate (PETE), polytetramethylene glycol (PTG), or polyurethane as well as mixtures thereof. As used herein, a mixture refers to the use of different polymers within the same compound as well as in reference to block copolymers. In some cases, block copolymers are polymers wherein at least one section of a polymer is build up from monomers of another polymer. In some instances, the polymer moiety C comprises polyalkylene oxide. In some instances, the polymer moiety C comprises PEG. In some instances, the polymer moiety C comprises polyethylene imide (PEI) or hydroxy ethyl starch (HES).

In some instances, C is a PEG moiety. In some instances, the PEG moiety is conjugated at the 5' terminus of the polynucleic acid molecule while the binding moiety is conjugated at the 3' terminus of the polynucleic acid molecule. In some instances, the PEG moiety is conjugated at the 3' terminus of the polynucleic acid molecule while the binding moiety is conjugated at the 5' terminus of the polynucleic acid molecule. In some instances, the PEG moiety is conjugated to an internal site of the polynucleic acid molecule. In some instances, the PEG moiety, the binding moiety, or a combination thereof, are conjugated to an internal site of the polynucleic acid molecule. In some instances, the conjugation is a direct conjugation. In some instances, the conjugation is via native ligation.

In some embodiments, the polyalkylene oxide (e.g., PEG) is a polydispers or monodispers compound. In some instances, polydispers material comprises disperse distribution of different molecular weight of the material, characterized by mean weight (weight average) size and dispersity. In some instances, the monodisperse PEG comprises one size of molecules. In some embodiments, C is poly- or monodispersed polyalkylene oxide (e.g., PEG) and the indicated molecular weight represents an average of the molecular weight of the polyalkylene oxide, e.g., PEG, molecules.

In some embodiments, the molecular weight of the polyalkylene oxide (e.g., PEG) is about 200, 300, 400, 500, 600, 700, 800, 900, 1000, 1100, 1200, 1300, 1400, 1450, 1500, 1600, 1700, 1800, 1900, 2000, 2100, 2200, 2300, 2400, 2500, 2600, 2700, 2800, 2900, 3000, 3250, 3350, 3500, 3750, 4000, 4250, 4500, 4600, 4750, 5000, 5500, 6000, 6500, 7000, 7500, 8000, 10,000, 12,000, 20,000, 35,000, 40,000, 50,000, 60,000, or 100,000 Da.

In some embodiments, C is polyalkylene oxide (e.g., PEG) and has a molecular weight of about 200, 300, 400, 500, 600, 700, 800, 900, 1000, 1100, 1200, 1300, 1400, 1450, 1500, 1600, 1700, 1800, 1900, 2000, 2100, 2200, 2300, 2400, 2500, 2600, 2700, 2800, 2900, 3000, 3250, 3350, 3500, 3750, 4000, 4250, 4500, 4600, 4750, 5000, 5500, 6000, 6500, 7000, 7500, 8000, 10,000, 12,000, 20,000, 35,000, 40,000, 50,000, 60,000, or 100,000 Da. In some embodiments, C is PEG and has a molecular weight of about 200, 300, 400, 500, 600, 700, 800, 900, 1000, 1100, 1200, 1300, 1400, 1450, 1500, 1600, 1700, 1800, 1900, 2000, 2100, 2200, 2300, 2400, 2500, 2600, 2700, 2800, 2900, 3000, 3250, 3350, 3500, 3750, 4000, 4250, 4500, 4600, 4750, 5000, 5500, 6000, 6500, 7000, 7500, 8000, 10,000, 12,000, 20,000, 35,000, 40,000, 50,000, 60,000, or 100,000 Da. In some instances, the molecular weight of C is about 200 Da. In some instances, the molecular weight of C is about 300 Da. In some instances, the molecular weight of C is about 400 Da. In some instances, the molecular weight of C is about 500 Da. In some instances, the molecular weight of C is about 600 Da. In some instances, the molecular weight of C is about 700 Da. In some instances, the molecular weight of C is about 800 Da. In some instances, the molecular weight of C is about 900 Da. In some instances, the molecular weight of C is about 1000 Da. In some instances, the molecular weight of C is about 1100 Da. In some instances, the molecular weight of C is about 1200 Da. In some instances, the molecular weight of C is about 1300 Da. In some instances, the molecular weight of C is about 1400 Da. In some instances, the molecular weight of C is about 1450 Da. In some instances, the molecular weight of C is about 1500 Da. In some instances, the molecular weight of C is about 1600 Da. In some instances, the molecular weight of C is about 1700 Da. In some instances, the molecular weight of C is about 1800 Da. In some instances, the molecular weight of C is about 1900 Da. In some instances, the molecular weight of C is about 2000 Da. In some instances, the molecular weight of C is about 2100 Da. In some instances, the molecular weight of C is about 2200 Da. In some instances, the molecular weight of C is about 2300 Da. In some instances, the molecular weight of C is about 2400 Da. In some instances, the molecular weight of C is about 2500 Da. In some instances, the molecular weight of C is about 2600 Da. In some instances, the molecular weight of C is about 2700 Da. In some instances, the molecular weight of C is about 2800 Da. In some instances, the molecular weight of C is about 2900 Da. In some instances, the molecular weight of C is about 3000 Da. In some instances, the molecular weight of C is about 3250 Da. In some instances, the molecular weight of C is about 3350 Da. In some instances, the molecular weight of C is about 3500 Da. In some instances, the molecular weight of C is about 3750 Da. In some instances, the molecular weight of C is about 4000 Da. In some instances, the molecular weight of C is about 4250 Da. In some instances, the molecular weight of C is about 4500 Da. In some instances, the molecular weight of C is about 4600 Da. In some instances, the molecular weight of C is about 4750 Da. In some instances, the molecular weight of C is about 5000 Da. In some instances, the molecular weight of C is about 5500 Da. In some instances, the molecular weight of C is about 6000 Da. In some instances, the molecular weight of C is about 6500 Da. In some instances, the molecular weight of C is about 7000 Da. In some instances, the molecular weight of C is about 7500 Da. In some instances, the molecular weight of C is about 8000 Da. In some instances, the molecular weight of C is about 10,000 Da. In some instances, the molecular weight of C is about 12,000 Da. In some instances, the molecular weight of C is about 20,000 Da. In some instances, the molecular weight of C is about 35,000 Da. In some instances, the molecular weight of C is about 40,000 Da. In some instances, the molecular weight of C is about 50,000 Da. In some instances, the molecular weight of C is about 60,000 Da. In some instances, the molecular weight of C is about 100,000 Da.

In some embodiments, the polyalkylene oxide (e.g., PEG) is a discrete PEG, in which the discrete PEG is a polymeric PEG comprising more than one repeating ethylene oxide units. In some instances, a discrete PEG (dPEG) comprises from 2 to 60, from 2 to 50, or from 2 to 48 repeating ethylene oxide units. In some instances, a dPEG comprises about 2, 3, 4, 5, 6, 7, 8, 9, 10, 11, 12, 13, 14, 15, 16, 17, 18, 19, 20, 22, 24, 26, 28, 30, 35, 40, 42, 48, 50 or more repeating ethylene oxide units. In some instances, a dPEG comprises about 2 or more repeating ethylene oxide units. In some instances, a dPEG comprises about 3 or more repeating ethylene oxide units. In some instances, a dPEG comprises about 4 or more repeating ethylene oxide units. In some instances, a dPEG comprises about 5 or more repeating ethylene oxide units. In some instances, a dPEG comprises about 6 or more repeating ethylene oxide units. In some instances, a dPEG comprises about 7 or more repeating ethylene oxide units. In some instances, a dPEG comprises about 8 or more repeating ethylene oxide units. In some instances, a dPEG comprises about 9 or more repeating ethylene oxide units. In some instances, a dPEG comprises about 10 or more repeating ethylene oxide units. In some instances, a dPEG comprises about 11 or more repeating ethylene oxide units. In some instances, a dPEG comprises about 12 or more repeating ethylene oxide units. In some instances, a dPEG comprises about 13 or more repeating ethylene oxide units. In some instances, a dPEG comprises about 14 or more repeating ethylene oxide units. In some instances, a dPEG comprises about 15 or more repeating ethylene oxide units. In some instances, a dPEG comprises about 16 or more repeating ethylene oxide units. In some instances, a dPEG comprises about 17 or more repeating ethylene oxide units. In some instances, a dPEG comprises about 18 or more repeating ethylene oxide units. In some instances, a dPEG comprises about 19 or more repeating ethylene oxide units. In some instances, a dPEG comprises about 20 or more repeating ethylene oxide units. In some instances, a dPEG comprises about 22 or more repeating ethylene oxide units. In some instances, a dPEG comprises about 24 or more repeating ethylene oxide units. In some instances, a dPEG comprises about 26 or more repeating ethylene oxide units. In some instances, a dPEG comprises about 28 or more repeating ethylene oxide units. In some instances, a dPEG comprises about 30 or more repeating ethylene oxide units. In some instances, a dPEG comprises about 35 or more repeating ethylene oxide units. In some instances, a dPEG comprises about 40 or more repeating ethylene oxide units. In some instances, a dPEG comprises about 42 or more repeating ethylene oxide units. In some instances, a dPEG comprises about 48 or more repeating ethylene oxide units. In some instances, a dPEG comprises about 50 or more repeating ethylene oxide units. In some cases, a dPEG is synthesized as a single molecular weight compound from pure (e.g., about 95%, 98%, 99%, or 99.5%) staring material in a step-wise fashion. In some cases, a dPEG has a specific molecular weight, rather than an average molecular weight. In some cases, a dPEG described herein is a dPEG from Quanta Biodesign, LMD.

In some embodiments, the polymer moiety C comprises a cationic mucic acid-based polymer (cMAP). In some instances, cMPA comprises one or more subunit of at least one repeating subunit, and the subunit structure is represented as Formula (III):

Formula III

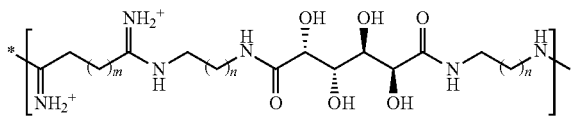

wherein m is independently at each occurrence 1, 2, 3, 4, 5, 6, 7, 8, 9, or 10, preferably 4-6 or 5; and n is independently at each occurrence 1, 2, 3, 4, or 5. In some embodiments, m and n are, for example, about 10.

In some instances, cMAP is further conjugated to a PEG moiety, generating a cMAP-PEG copolymer, an mPEG-cMAP-PEGm triblock polymer, or a cMAP-PEG-cMAP triblock polymer. In some instances, the PEG moiety is in a range of from about 500 Da to about 50,000 Da. In some instances, the PEG moiety is in a range of from about 500 Da to about 1000 Da, greater than 1000 Da to about 5000 Da, greater than 5000 Da to about 10,000 Da, greater than 10,000 to about 25,000 Da, greater than 25,000 Da to about 50,000 Da, or any combination of two or more of these ranges.

In some instances, the polymer moiety C is cMAP-PEG copolymer, an mPEG-cMAP-PEGm triblock polymer, or a cMAP-PEG-cMAP triblock polymer. In some cases, the polymer moiety C is cMAP-PEG copolymer. In other cases, the polymer moiety C is an mPEG-cMAP-PEGm triblock polymer. In additional cases, the polymer moiety C is a cMAP-PEG-cMAP triblock polymer.

Endosomolytic or Cell Membrane Penetration Moiety

In some embodiments, a molecule of Formula (Xa): A-X$_1$-B'-X$_2$-C, further comprises an additional conjugating moiety. In some instances, the additional conjugating moiety is an endosomolytic moiety and/or a cell membrane penetration moiety. In some cases, the endosomolytic moiety is a cellular compartmental release component, such as a compound capable of releasing from any of the cellular compartments known in the art, such as the endosome, lysosome, endoplasmic reticulum (ER), Golgi apparatus, microtubule, peroxisome, or other vesicular bodies with the cell. In some cases, the endosomolytic moiety comprises an endosomolytic polypeptide, an endosomolytic polymer, an endosomolytic lipid, or an endosomolytic small molecule. In some cases, the endosomolytic moiety comprises an endosomolytic polypeptide. In other cases, the endosomolytic moiety comprises an endosomolytic polymer. In some cases, the cell membrane penetration moiety comprises a cell penetrating peptide (CPP). In other cases, the cell membrane penetration moiety comprises a cell penetrating lipid. In other cases, the cell membrane penetration moiety comprises a cell penetrating small molecule.

Endosomolytic and Cell Membrane Penetration Polypeptides

In some embodiments, a molecule of Formula (Xa): A-X$_1$-B-X$_2$-C, is further conjugated with an endosomolytic polypeptide. In some cases, the endosomolytic polypeptide is a pH-dependent membrane active peptide. In some cases, the endosomolytic polypeptide is an amphipathic polypeptide. In additional cases, the endosomolytic polypeptide is a peptidomimetic. In some instances, the endosomolytic polypeptide comprises INF, melittin, meucin, or their respective derivatives thereof. In some instances, the endosomolytic polypeptide comprises INF or its derivatives thereof. In other cases, the endosomolytic polypeptide comprises melittin or its derivatives thereof. In additional cases, the endosomolytic polypeptide comprises meucin or its derivatives thereof. In some instances, the endosomolytic polypeptide comprises Pep-1 (originated from NLS from Simian Virus 40 large antigen and reverse transcriptase of HIV), Pvec (originated from VE-Cadherin), VT5 (originated from synthetic peptide), C105Y (originated from 1-antitrypsin), transportan (originated from Galanin and mastoparan), TP10 (originated from Galanin and mastoparan), MPG (originated from a hydrophobic domain from the fusion sequence of HIV gp41 and NLS of SV40 T antigen), GH625 (originated from glycoprotein gH of HSV type 1), CADY (PPTG1 peptide), GALA (synthetic peptide), INF (Influenza HA2 fusion peptide), HA2E5-TAT (Influenza HA2 subunit of influenza virus X31 strain fusion peptide), HA2-penetratin (Influenza HA2 subunit of influenza virus X31 strain fusion peptide), HA-K4 (Influenza HA2 subunit of influenza virus X31 strain fusion peptide), HA2E4 (Influenza HA2 subunit of influenza virus X31 strain fusion peptide), H5WYG (HA2 analogue), GALA-INF3-(PEG)6-NH (INF3 fusion peptide), or CM18-TAT11 (Cecropin-A-Melittin$_{2-12}$ (CM$_{18}$) fusion peptide).

In some cases, the endosomolytic moiety comprises a Bak BH3 polypeptide which induces apoptosis through antagonization of suppressor targets such as Bcl-2 and/or Bcl-x$_L$. In some instances, the endosomolytic moiety comprises a Bak BH3 polypeptide described in Albarran, et al., "Efficient intracellular delivery of a pro-apoptotic peptide with a pH-responsive carrier," *Reactive & Functional Polymers* 71: 261-265 (2011).

In some instances, the endosomolytic moiety comprises a polypeptide (e.g., a cell-penetrating polypeptide) as described in PCT Publication Nos. WO2013/166155 or WO2015/069587.

Endosomolytic Lipids

In some embodiments, the endosomolytic moiety is a lipid (e.g., a fusogenic lipid). In some embodiments, a molecule of Formula (Xa): A-X$_1$-B'-X2-C, is further conjugated with an endosomolytic lipid (e.g., fusogenic lipid). Exemplary fusogenic lipids include 1,2-dileoyl-sn-3-phosphoethanolamine (DOPE), phosphatidylethanolamine (POPE), palmitoyloleoylphosphatidylcholine (POPC), (6Z, 9Z,28Z,31Z)-heptatriaconta-6,9,28,31-tetraen-19-ol (DiLin), N-methyl(2,2-di((9Z,12Z)-octadeca-9,12-dienyl)-1,3-dioxolan-4-yl)methanamine (DLin-k-DMA) and N-methyl-2-(2,2-di((9Z,12Z)-octadeca-9,12-dienyl)-1,3-dioxolan-4-yl)ethanamine (XTC). In some instances, an endosomolytic moiety is a lipid (e.g., a fusogenic lipid) described in PCT Publication No. WO09/126,933.

Endosomolytic Small Molecules

In some embodiments, the endosomolytic moiety is a small molecule. In some embodiments, a molecule of Formula (Xa): A-X$_1$-B'-X$_2$-C, is further conjugated with an endosomolytic small molecule. Exemplary small molecules suitable as endosomolytic moieties include, but are not limited to, quinine, chloroquine, hydroxychloroquines, amodiaquins (camoquines), amopyroquines, primaquines, mefloquines, nivaquines, halofantrines, quinone imines, or a combination thereof. In some instances, quinoline endosomolytic moieties include, but are not limited to, 7-chloro-4-(4-diethylamino-1-methylbutyl-amino)quinoline (chloroquine); 7-chloro-4-(4-ethyl-(2-hydroxyethyl)-amino-1-methylbutyl-amino)quinoline (hydroxychloroquine); 7-fluoro-4-(4-diethylamino-1-methylbutyl-amino)quinoline; 4-(4-diethylamino-1-methylbutylamino) quinoline; 4-hydroxy-4-(4-diethyl-amino-1-methylbutylamino)quinoline; 7-chloro-4-(4-diethylamino-1-butylamino)quinoline (desmethylchloroquine); 7-fluoro-4-(4-diethylamino-1-butylamino)quinoline); 4-(4-diethyl-amino-1-butylamino) quinoline; 7-hydroxy-4-(4-diethylamino-1-butylamino)quinoline; 7-chloro-4-(1-carboxy-4-diethylamino-1-butylamino)quinoline; 7-fluoro-4-(1-carboxy-4-diethyl-amino-1-butylamino)quinoline; 4-(1-carboxy-4-diethylamino-1-butylamino) quinoline; 7-hydroxy-4-(1-carboxy-4-diethylamino-1-butylamino)quinoline; 7-chloro-4-(1-carboxy-4-diethylamino-1-methylbutylamino) quinoline; 7-fluoro-4-(1-carboxy-4-diethyl-amino-1-methylbutylamino)quinoline; 4-(1-carboxy-4-diethylamino-1-methylbutylamino)quinoline; 7-hydroxy-4-(1-carboxy-4-diethylamino-1-methylbutylamino)quinoline; 7-fluoro-4-(4-ethyl-(2-hydroxyethyl)-amino-1-methylbutylamino) quinoline; 4-(4-ethyl-(2-hydroxy-ethyl)-amino-1-methylbutylamino-)quinoline; 7-hydroxy-4-(4-ethyl-(2-hydroxyethyl)-amino-1-methylbutylamino)quinoline; hydroxychloroquine phosphate; 7-chloro-4-(4-ethyl-(2-hydroxyethyl-1)-amino-1-butylamino)quinoline (desmethylhydroxychloroquine); 7-fluoro-4-(4-ethyl-(2-hydroxyethyl)-amino-1-butylamino)quinoline; 4-(4-ethyl-(2-hydroxyethyl)-amino-1-butylamino)quinoline; 7-hydroxy-4-(4-ethyl-(2-hydroxyethyl)-amino-1-butylamino) quinoline; 7-chloro-4-(1-carboxy-4-ethyl-(2-hydroxyethyl)-amino-1-butylamino)quinoline; 7-fluoro-4-(1-carboxy-4-ethyl-(2-hydroxyethyl)-amino-1-butylamino)quinoline; 4-(1-carboxy-4-ethyl-(2-hydroxyethyl)-amino-1-butylamino)quinoline; 7-hydroxy-4-(1-carboxy-4-ethyl-(2-hydroxyethyl)-amino-1-butylamino)quinoline; 7-chloro-4-(1-carboxy-4-ethyl-(2-hydroxyethyl)-amino-1-methylbutylamino)quinoline; 7-fluoro-4-(1-carboxy-4-ethyl-(2-hydroxyethyl)-amino-1-methylbutylamino) quinoline; 4-(1-carboxy-4-ethyl-(2-hydroxyethyl)-amino-1-methylbutylamino)quinoline; 7-hydroxy-4-(1-carboxy-4-ethyl-(2-hydroxyethyl)-amino-1-methylbutylamino) quinoline; 8-[(4-aminopentyl)amino-6-methoxydihydrochloride quinoline; 1-acetyl-1,2,3,4-tetrahydroquinoline; 8-[(4-aminopentyl)amino]-6-methoxyquinoline dihydrochloride; 1-butyryl-1,2,3,4-tetrahydroquinoline; 3-chloro-4-(4-hydroxy-alpha,alpha'-bis(2-methyl-1-pyrrolidinyl)-2,5-xylidinoquinoline, 4-[(4-diethyl-amino)-1-methylbutyl-amino]-6-methoxyquinoline; 3-fluoro-4-(4-hydroxy-alpha,alpha'-bis(2-methyl-1-pyrrolidinyl)-2,5-xylidinoquinoline, 4-[(4-diethylamino)-1-methylbutyl-amino]-6-methoxyquinoline; 4-(4-hydroxy-alpha,alpha'-bis(2-methyl-1-pyrrolidinyl)-2,5-xylidinoquinoline; 4-[(4-diethylamino)-1-methylbutyl-amino]-6-methoxyquinoline; 3,4-dihydro-1-(2H)-quinolinecarboxyaldehyde; 1,1'-pentamethylene diquinoleinium diiodide; 8-quinolinol sulfate and amino, aldehyde, carboxylic, hydroxyl, halogen, keto, sulfhydryl and vinyl derivatives or analogs thereof. In some instances, an endosomolytic moiety is a small molecule described in Naisbitt et al (1997, J Pharmacol Exp Therapy 280:884-893) and in U.S. Pat. No. 5,736,557.

Cell Penetrating Polypeptide (CPP)

In some embodiments, cell penetrating polypeptide comprises positively charged short peptides with 5-30 amino acids. In some embodiments, cell penetrating polypeptide comprises arginine or lysine rich amino acid sequences. In some embodiments, cell penetrating polypeptide includes any polypeptide or combination thereof, including Antennapedia Penetratin (43-58), HIV-1 TAT protein (48-60), pVEC Cadherin (615-632), Transportan Galanine/Mastoparan, MPG HIV-gp41/SV40 T-antigen, Pep-1 HIV-reverse transcriptase/SV40 T-antigen, Polyargnines, MAP, R6W3, NLS, 8-lysines, ARF (1-22), and Azurin-p28.

Linkers

In some embodiments, a linker described herein is a cleavable linker or a non-cleavable linker. In some instances, the linker is a cleavable linker. In some instances, the linker is an acid cleavable linker. In some instances, the linker is a non-cleavable linker. In some instances, the linker includes a $C_1$-$C_6$ alkyl group (e.g., a $C_5$, $C_4$, $C_3$, $C_2$, or $C_1$ alkyl group). In some instances, the linker includes homobifunctional cross linkers, heterobifunctional cross linkers, and the like. In some instances, the liker is a traceless linker (or a zero-length linker). In some instances, the linker is a non-polymeric linker. In some cases, the linker is a non-peptide linker or a linker that does not contain an amino acid residue.

In some instances, the linker comprises a homobifunctional linker. Exemplary homobifunctional linkers include, but are not limited to, Lomant's reagent dithiobis (succinimidylpropionate) DSP, 3'3'-dithiobis(sulfosuccinimidyl proprionate (DTSSP), disuccinimidyl suberate (DSS), bis (sulfosuccinimidyl)suberate (BS), disuccinimidyl tartrate (DST), disulfosuccinimidyl tartrate (sulfo DST), ethylene glycobis(succinimidylsuccinate) (EGS), disuccinimidyl glutarate (DSG), N,N'-disuccinimidyl carbonate (DSC), dimethyl adipimidate (DMA), dimethyl pimelimidate (DMP), dimethyl suberimidate (DMS), dimethyl-3,3'-dithiobispropionimidate (DTBP), 1,4-di-3'-(2'-pyridyldithio)propionamido)butane (DPDPB), bismaleimidohexane (BMH), aryl halide-containing compound (DFDNB), such as e.g. 1,5-difluoro-2,4-dinitrobenzene or 1,3-difluoro-4,6-dinitrobenzene, 4,4'-difluoro-3,3'-dinitrophenylsulfone (DFDNPS), bis-[β-(4-azidosalicylamido)ethyl]disulfide (BASED), formaldehyde, glutaraldehyde, 1,4-butanediol diglycidyl ether, adipic acid dihydrazide, carbohydrazide, o-toluidine, 3,3'-dimethylbenzidine, benzidine, α,α'-p-diaminodiphenyl, diiodo-p-xylene sulfonic acid, N,N'-ethylene-bis(iodoacetamide), or N,N'-hexamethylene-bis(iodoacetamide).

In some embodiments, the linker comprises a heterobifunctional linker. Exemplary heterobifunctional linker include, but are not limited to, amine-reactive and sulfhydryl cross-linkers such as N-succinimidyl 3-(2-pyridyldithio) propionate (sPDP), long-chain N-succinimidyl 3-(2-pyridyldithio)propionate (LC-sPDP), water-soluble-long-chain N-succinimidyl 3-(2-pyridyldithio) propionate (sulfo-LC-sPDP), succinimidyloxycarbonyl-α-methyl-α-(2-pyridyldithio)toluene (sMPT), sulfosuccinimidyl-6-[α-methyl-α-(2-pyridyldithio)toluamido]hexanoate (sulfo-LC-sMPT), succinimidyl-4-(N-maleimidomethyl)cyclohexane-1-carboxylate (sMCC), sulfosuccinimidyl-4-(N-maleimidomethyl)cyclohexane-1-carboxylate (sulfo-sMCC), m-maleimidobenzoyl-N-hydroxysuccinimide ester (MBs), m-maleimidobenzoyl-N-hydroxysulfosuccinimide ester (sulfo-MBs), N-succinimidyl(4-iodoacteyl)aminobenzoate (sIAB), sulfosuccinimidyl(4-iodoacteyl)aminobenzoate (sulfo-sIAB), succinimidyl-4-(p-maleimidophenyl)butyrate (sMPB), sulfosuccinimidyl-4-(p-maleimidophenyl)butyrate (sulfo-sMPB), N-(γ-maleimidobutyryloxy)succinimide ester (GMBs), N-(γ-maleimidobutyryloxy)sulfosuccinimide ester (sulfo-GMBs), succinimidyl 6-((iodoacetyl)amino)hexanoate (sIAX), succinimidyl 6-[6-(((iodoacetyl)amino) hexanoyl)amino]hexanoate (sIAXX), succinimidyl 4-(((iodoacetyl)amino)methyl)cyclohexane-1-carboxylate (sIAC), succinimidyl 6-((((4-iodoacetyl)amino)methyl)cyclohexane-1-carbonyl)amino) hexanoate (sIACX), p-nitrophenyl iodoacetate (NPIA), carbonyl-reactive and sulfhydryl-reactive cross-linkers such as 4-(4-N-maleimidophenyl) butyric acid hydrazide (MPBH), 4-(N-maleimidomethyl) cyclohexane-1-carboxyl-hydrazide-8 (M2C$_2$H), 3-(2-pyridyldithio)propionyl hydrazide (PDPH), amine-reactive and photoreactive cross-linkers such as N-hydroxysuccinimidyl-4-azidosalicylic acid (NHs-AsA), N-hydroxysulfosuccinimidyl-4-azidosalicylic acid (sulfo-NHs-AsA), sulfosuccinimidyl-(4-azidosalicylamido)hexanoate (sulfo-NHs-LC-AsA), sulfosuccinimidyl-2-(p-azidosalicylamido)ethyl-1,3'-dithiopropionate (sAsD), N-hydroxysuccinimidyl-4-azidobenzoate (HsAB), N-hydroxysulfosuccinimidyl-4-azidobenzoate (sulfo-HsAB), N-succinimidyl-6-(4'-azido-2'-nitrophenylamino)hexanoate (sANPAH), sulfosuccinimidyl-6-(4'-azido-2'-nitrophenylamino)hexanoate (sulfo-sANPAH), N-5-azido-2-nitrobenzoyloxysuccinimide (ANB-NOs), sulfosuccinimidyl-2-(m-azido-o-nitrobenzamido)-ethyl-1,3'-dithiopropionate (sAND), N-succinimidyl-4(4-azidophenyl)1,3'-dithiopropionate (sADP), N-sulfosuccinimidyl(4-azidophenyl)-1,3'-dithiopropionate (sulfo-sADP), sulfosuccinimidyl 4-(p-azidophenyl)butyrate (sulfo-sAPB), sulfosuccinimidyl-2-(7-azido-4-methylcoumarin-3-acetamide)ethyl-1,3'-dithiopropionate (sAED), sulfosuccinimidyl 7-azido-4-methylcoumain-3-acetate (sulfo-sAMCA), ρ-nitrophenyl diazopyruvate (ρNPDP), ρ-nitrophenyl-2-diazo-3,3,3-trifluoropropionate (PNP-DTP), sulfhydryl-reactive and photoreactive cross-linkers such as1-(ρ-Azidosalicylamido)-4-(iodoacetamido) butane (AsIB), N-[4-(ρ-azidosalicylamido)butyl]-3'-(2'-pyridyldithio)propionamide (APDP), benzophenone-4-iodoacetamide, benzophenone-4-maleimide carbonyl-reactive and photoreactive cross-linkers such as ρ-azidobenzoyl hydrazide (ABH), carboxylate-reactive and photoreactive cross-linkers such as 4-(ρ-azidosalicylamido) butylamine (AsBA), and arginine-reactive and photoreactive cross-linkers such as ρ-azidophenyl glyoxal (APG).

In some instances, the linker comprises a reactive functional group. In some cases, the reactive functional group comprises a nucleophilic group that is reactive to an electrophilic group present on a binding moiety. Exemplary electrophilic groups include carbonyl groups-such as aldehyde, ketone, carboxylic acid, ester, amide, enone, acyl halide or acid anhydride. In some embodiments, the reactive functional group is aldehyde. Exemplary nucleophilic groups include hydrazide, oxime, amino, hydrazine, thiosemicarbazone, hydrazine carboxylate, and arylhydrazide.

In some embodiments, the linker comprises a maleimide group. In some instances, the maleimide group is also referred to as a maleimide spacer. In some instances, the maleimide group further encompasses a caproic acid, forming maleimidocaproyl (mc). In some cases, the linker comprises maleimidocaproyl (mc). In some cases, the linker is maleimidocaproyl (mc). In other instances, the maleimide group comprises a maleimidomethyl group, such as succinimidyl-4-(N-maleimidomethyl)cyclohexane-1-carboxylate (sMCC) or sulfosuccinimidyl-4-(N-maleimidomethyl)cyclohexane-1-carboxylate (sulfo-sMCC) described above.

In some embodiments, the maleimide group is a self-stabilizing maleimide. In some instances, the self-stabilizing maleimide utilizes diaminopropionic acid (DPR) to incorporate a basic amino group adjacent to the maleimide to provide intramolecular catalysis of tiosuccinimide ring hydrolysis, thereby eliminating maleimide from undergoing an elimination reaction through a retro-Michael reaction. In some instances, the self-stabilizing maleimide is a maleimide group described in Lyon, et al., "Self-hydrolyzing maleimides improve the stability and pharmacological properties of antibody-drug conjugates," *Nat. Biotechnol.* 32(10): 1059-1062 (2014). In some instances, the linker comprises a self-stabilizing maleimide. In some instances, the linker is a self-stabilizing maleimide.

In some embodiments, the linker comprises a peptide moiety. In some instances, the peptide moiety comprises at least 2, 3, 4, 5, 6, 7, 8, or more amino acid residues. In some instances, the peptide moiety is a cleavable peptide moiety (e.g., either enzymatically or chemically). In some instances, the peptide moiety is a non-cleavable peptide moiety. In some instances, the peptide moiety comprises Val-Cit (valine-citrulline), Gly-Gly-Phe-Gly (SEQ ID NO: 14223), Phe-Lys, Val-Lys, Gly-Phe-Lys, Phe-Phe-Lys, Ala-Lys, Val-Arg, Phe-Cit, Phe-Arg, Leu-Cit, Ile-Cit, Trp-Cit, Phe-Ala, Ala-Leu-Ala-Leu (SEQ ID NO: 14224), or Gly-Phe-Leu-Gly (SEQ ID NO: 14225). In some instances, the linker comprises a peptide moiety such as: Val-Cit (valine-citrulline), Gly-Gly-Phe-Gly (SEQ ID NO: 14223), Phe-Lys, Val-Lys, Gly-Phe-Lys, Phe-Phe-Lys, Ala-Lys, Val-Arg, Phe-Cit, Phe-Arg, Leu-Cit, Ile-Cit, Trp-Cit, Phe-Ala, Ala-Leu-Ala-Leu (SEQ ID NO: 14224), or Gly-Phe-Leu-Gly (SEQ ID NO: 14225). In some cases, the linker comprises Val-Cit. In some cases, the linker is Val-Cit.

In some embodiments, the linker comprises a benzoic acid group, or its derivatives thereof. In some instances, the benzoic acid group or its derivatives thereof comprise paraaminobenzoic acid (PABA). In some instances, the benzoic acid group or its derivatives thereof comprise gamma-aminobutyric acid (GABA).

In some embodiments, the linker comprises one or more of a maleimide group, a peptide moiety, and/or a benzoic acid group, in any combination. In some embodiments, the linker comprises a combination of a maleimide group, a peptide moiety, and/or a benzoic acid group. In some instances, the maleimide group is maleimidocaproyl (mc). In some instances, the peptide group is val-cit. In some instances, the benzoic acid group is PABA. In some instances, the linker comprises a mc-val-cit group. In some cases, the linker comprises a val-cit-PABA group. In additional cases, the linker comprises a mc-val-cit-PABA group.

In some embodiments, the linker is a self-immolative linker or a self-elimination linker. In some cases, the linker is a self-immolative linker. In other cases, the linker is a self-elimination linker (e.g., a cyclization self-elimination linker). In some instances, the linker comprises a linker described in U.S. Pat. No. 9,089,614 or PCT Publication No. WO2015038426.

In some embodiments, the linker is a dendritic type linker. In some instances, the dendritic type linker comprises a branching, multifunctional linker moiety. In some instances, the dendritic type linker is used to increase the molar ratio of polynucleotide B to the binding moiety A. In some instances, the dendritic type linker comprises PAMAM dendrimers.

In some embodiments, the linker is a traceless linker or a linker in which after cleavage does not leave behind a linker moiety (e.g., an atom or a linker group) to a binding moiety A, a polynucleotide B, a polymer C, or an endosomolytic moiety D. Exemplary traceless linkers include, but are not limited to, germanium linkers, silicium linkers, sulfur linkers, selenium linkers, nitrogen linkers, phosphorus linkers, boron linkers, chromium linkers, or phenylhydrazide linker. In some cases, the linker is a traceless aryl-triazene linker as described in Hejesen, et al., "A traceless aryl-triazene linker for DNA-directed chemistry," *Org Biomol Chem* 11(15): 2493-2497 (2013). In some instances, the linker is a traceless linker described in Blaney, et al., "Traceless solid-phase organic synthesis," *Chem. Rev.* 102: 2607-2024 (2002). In some instances, a linker is a traceless linker as described in U.S. Pat. No. 6,821,783.

In some instances, the linker comprises a functional group that exerts steric hinderance at the site of bonding between the linker and a conjugating moiety (e.g., A, B, C, or D described herein). In some instances, the steric hinderance is a steric hindrance around a disulfide bond. Exemplary linkers that exhibit steric hinderance comprises a heterobifunctional linker, such as a heterobifunctional linker described above. In some cases, a linker that exhibits steric hinderance comprises SMCC and SPDB.

In some instances, the linker is an acid cleavable linker. In some instances, the acid cleavable linker comprises a hydrazone linkage, which is susceptible to hydrolytic cleavage. In some cases, the acid cleavable linker comprises a thiomaleamic acid linker. In some cases, the acid cleavable linker is a thiomaleamic acid linker as described in Castaneda, et al, "Acid-cleavable thiomaleamic acid linker for homogeneous antibody-drug conjugation," *Chem. Commun.* 49: 8187-8189 (2013).

In some instances, the linker is a linker described in U.S. Pat. Nos. 6,884,869; 7,498,298; 8,288,352; 8,609,105; or 8,697,688; U.S. Patent Publication Nos. 2014/0127239; 2013/028919; 2014/286970; 2013/0309256; 2015/037360; or 2014/0294851; or PCT Publication Nos. WO2015057699; WO2014080251; WO2014197854; WO2014145090; or WO2014177042.

In some embodiments, X, Y, and L are independently a bond or a linker. In some instances, X, Y, and L are independently a bond. In some cases, X, Y, and L are independently a linker.

In some instances, X is a bond or a linker. In some instances, X is a bond. In some instances, X is a linker. In some instances, the linker is a $C_1$-$C_6$ alkyl group. In some cases, X is a $C_1$-$C_6$ alkyl group, such as for example, a $C_5$, $C_4$, $C_3$, $C_2$, or $C_1$ alkyl group. In some cases, the $C_1$-$C_6$ alkyl group is an unsubstituted $C_1$-$C_6$ alkyl group. As used in the context of a linker, and in particular in the context of X, alkyl means a saturated straight or branched hydrocarbon radical containing up to six carbon atoms. In some instances, X is a non-polymeric linker. In some instances, X includes a homobifunctional linker or a heterobifunctional linker described supra. In some cases, X includes a heterobifunctional linker. In some cases, X includes sMCC. In other instances, X includes a heterobifunctional linker optionally conjugated to a $C_1$-$C_6$ alkyl group. In other instances, X includes sMCC optionally conjugated to a $C_1$-$C_6$ alkyl group. In additional instances, X does not include a homobifunctional linker or a heterobifunctional linker described supra.

In some instances, Y is a bond or a linker. In some instances, Y is a bond. In other cases, Y is a linker. In some embodiments, Y is a $C_1$-$C_6$ alkyl group. In some instances, Y is a homobifunctional linker or a heterobifunctional linker described supra. In some instances, Y is a homobifunctional linker described supra. In some instances, Y is a heterobifunctional linker described supra. In some instances, Y comprises a maleimide group, such as maleimidocaproyl (me) or a self-stabilizing maleimide group described above. In some instances, Y comprises a peptide moiety, such as Val-Cit. In some instances, Y comprises a benzoic acid group, such as PABA. In additional instances, Y comprises a combination of a maleimide group, a peptide moiety, and/or a benzoic acid group. In additional instances, Y comprises a me group. In additional instances, Y comprises a mc-val-cit group. In additional instances, Y comprises a val-cit-PABA group. In additional instances, Y comprises a mc-val-cit-PABA group.

In some instances, L is a bond or a linker. In some cases, L is a bond. In other cases, L is a linker. In some embodiments, L is a $C_1$-$C_6$ alkyl group. In some instances, L is a homobifunctional linker or a heterobifunctional linker described supra. In some instances, L is a homobifunctional linker described supra. In some instances, L is a heterobifunctional linker described supra. In some instances, L comprises a maleimide group, such as maleimidocaproyl (me) or a self-stabilizing maleimide group described above. In some instances, L comprises a peptide moiety, such as Val-Cit. In some instances, L comprises a benzoic acid group, such as PABA. In additional instances, L comprises a combination of a maleimide group, a peptide moiety, and/or a benzoic acid group. In additional instances, L comprises a me group. In additional instances, L comprises a mc-val-cit group. In additional instances, L comprises a val-cit-PABA group. In additional instances, L comprises a mc-val-cit-PABA group.

Methods of Use

In some embodiments, a composition or a pharmaceutical formulation described herein comprising a binding moiety conjugated to a polynucleic acid molecule and a polymer is used for the treatment of a disease or disorder. In some instances, the disease or disorder is a muscle dystrophy, muscle atrophy, and/or muscle wasting. Muscle dystrophy refers to a loss of muscle mass and/or to a progressive weakening and degeneration of muscles. In some cases, the loss of muscle mass and/or the progressive weakening and degeneration of muscles occurs due to a high rate of protein degradation, a low rate of protein synthesis, or a combination of both. In some cases, a high rate of muscle protein degradation is due to muscle protein catabolism (i.e., the breakdown of muscle protein in order to use amino acids as substrates for gluconeogenesis). In some instances, the disease or disorder is a cancer. In some embodiments, a composition or a pharmaceutical formulation described herein is used as an immunotherapy for the treatment of a disease or disorder. In some instances, the immunotherapy is an immuno-oncology therapy.

Cancer

In some embodiments, a composition or a pharmaceutical formulation described herein is used for the treatment of cancer. In some instances, the cancer is a solid tumor. In some instances, the cancer is a hematologic malignancy. In some instances, the cancer is a relapsed or refractory cancer, or a metastatic cancer. In some instances, the solid tumor is a relapsed or refractory solid tumor, or a metastatic solid tumor. In some cases, the hematologic malignancy is a relapsed or refractory hematologic malignancy, or a metastatic hematologic malignancy.

In some instances, the cancer is a solid tumor. In some instances, a composition or a pharmaceutical formulation described herein comprising an oligonucleotide, optionally conjugated to a binding moiety, a polymer, or a combination thereof is used for the treatment of a solid tumor. In some instances, a composition or a pharmaceutical formulation described herein comprising an oligonucleotide, optionally conjugated to a binding moiety, a polymer, or a combination thereof is used for the treatment of anal cancer, appendix cancer, bile duct cancer (i.e., cholangiocarcinoma), bladder cancer, brain tumor, breast cancer, cervical cancer, colon cancer, cancer of Unknown Primary (CUP), esophageal cancer, eye cancer, fallopian tube cancer, gastroenterological cancer, kidney cancer, liver cancer, lung cancer, medulloblastoma, melanoma, oral cancer, ovarian cancer, pancreatic cancer, parathyroid disease, penile cancer, pituitary tumor, prostate cancer, rectal cancer, skin cancer, stomach cancer, testicular cancer, throat cancer, thyroid cancer, uterine cancer, vaginal cancer, or vulvar cancer. In some instances, the solid tumor is a relapsed or refractory solid tumor, or a metastatic solid tumor.

In some instances, the cancer is a hematologic malignancy. In some instances, a composition or a pharmaceutical formulation described herein comprising an oligonucleotide, optionally conjugated to a binding moiety, a polymer, or a combination thereof is used for the treatment of a hematologic malignancy. In some instances, a composition or a pharmaceutical formulation described herein comprising an oligonucleotide, optionally conjugated to a binding moiety, a polymer, or a combination thereof is used for the treatment of a leukemia, a lymphoma, a myeloma, a non-Hodgkin's lymphoma, or a Hodgkin's lymphoma. In some instances, the hematologic malignancy comprises chronic lymphocytic leukemia (CLL), small lymphocytic lymphoma (SLL), high risk CLL, a non-CLL/SLL lymphoma, prolymphocytic leukemia (PLL), follicular lymphoma (FL), diffuse large B-cell lymphoma (DLBCL), mantle cell lymphoma (MCL), Waldenström's macroglobulinemia, multiple myeloma, extranodal marginal zone B cell lymphoma, nodal marginal zone B cell lymphoma, Burkitt's lymphoma, non-Burkitt high grade B cell lymphoma, primary mediastinal B-cell lymphoma (PMBL), immunoblastic large cell lymphoma, precursor B-lymphoblastic lymphoma, B cell prolymphocytic leukemia, lymphoplasmacytic lymphoma, splenic marginal zone lymphoma, plasma cell myeloma, plasmacytoma, mediastinal (thymic) large B cell lymphoma, intravascular large B cell lymphoma, primary effusion lymphoma, or lymphomatoid granulomatosis. In some cases, the hematologic malignancy is a relapsed or refractory hematologic malignancy, or a metastatic hematologic malignancy.

In some instances, the cancer is a KRAS-associated, EGFR-associated, AR-associated cancer, HPRT1-associated cancer, or β-catenin associated cancer. In some instances, a composition or a pharmaceutical formulation described herein comprising an oligonucleotide, optionally conjugated to a binding moiety, a polymer, or a combination thereof is used for the treatment of a KRAS-associated, EGFR-associated, AR-associated cancer, HPRT1-associated cancer, or β-catenin associated cancer. In some instances, a composition or a pharmaceutical formulation described herein comprising an oligonucleotide, optionally conjugated to a binding moiety, a polymer, or a combination thereof is used for the treatment of a KRAS-associated cancer. In some instances, a composition or a pharmaceutical formulation described herein comprising an oligonucleotide, optionally conjugated to a binding moiety, a polymer, or a combination thereof is used for the treatment of an EGFR-associated cancer. In some instances, a composition or a pharmaceutical formulation described herein comprising an oligonucleotide, optionally conjugated to a binding moiety, a polymer, or a combination thereof is used for the treatment of an AR-associated cancer. In some instances, a composition or a pharmaceutical formulation described herein comprising an oligonucleotide, optionally conjugated to a binding moiety, a polymer, or a combination thereof is used for the treatment of an HPRT1-associated cancer. In some instances, a composition or a pharmaceutical formulation described herein comprising an oligonucleotide, optionally conjugated to a binding moiety, a polymer, or a combination thereof is used for the treatment of a β-catenin associated cancer. In some instances, the cancer is a solid tumor. In some instances, the cancer is a hematologic malignancy. In some instances, the solid tumor is a relapsed or refractory solid tumor, or a metastatic solid tumor. In some cases, the hematologic malignancy is a relapsed or refractory hematologic malignancy, or a metastatic hematologic malignancy. In some instances, the cancer comprises bladder cancer, breast cancer, colorectal cancer, endometrial cancer, esophageal cancer, glioblastoma multiforme, head and neck cancer, kidney cancer, lung cancer, ovarian cancer, pancreatic cancer, prostate cancer, thyroid cancer, acute myeloid leukemia, CLL, DLBCL, or multiple myeloma. In some instances, the β-catenin associated cancer further comprises PIK3C-associated cancer and/or MYC-associated cancer.

Immunotherapy

In some embodiments, a composition or a pharmaceutical formulation described herein is used as an immunotherapy for the treatment of a disease or disorder. In some instances, the immunotherapy is an immuno-oncology therapy. In some instances, immuno-oncology therapy is categorized into active, passive, or combinatory (active and passive) methods. In active immuno-oncology therapy method, for example, tumor-associated antigens (TAAs) are presented to the immune system to trigger an attack on cancer cells presenting these TAAs. In some instances, the active immune-oncology therapy method includes tumor-targeting and/or immune-targeting agents (e.g., checkpoint inhibitor agents such as monoclonal antibodies), and/or vaccines, such as in situ vaccination and/or cell-based or non-cell based (e.g., dendritic cell-based, tumor cell-based, antigen, anti-idiotype, DNA, or vector-based) vaccines. In some instances, the cell-based vaccines are vaccines which are generated using activated immune cells obtained from a patient's own immune system which are then activated by the patient's own cancer. In some instances, the active immune-oncology therapy is further subdivided into non-specific active immunotherapy and specific active immunotherapy. In some instances, non-specific active immunotherapy utilizes cytokines and/or other cell signaling components to induce a general immune system response. In some cases, specific active immunotherapy utilizes specific TAAs to elicit an immune response.

In some embodiments, a composition or a pharmaceutical formulation described herein is used as an active immuno-oncology therapy method for the treatment of a disease or disorder (e.g., cancer). In some embodiments, the composition or a pharmaceutical formulation described herein comprises a tumor-targeting agent. In some instances, the tumor-targeting agent is encompassed by a binding moiety A. In other instances, the tumor-targeting agent is an additional agent used in combination with a molecule of Formula (I). In some instances, the tumor-targeting agent is a tumor-directed polypeptide (e.g., a tumor-directed antibody). In some instances, the tumor-targeting agent is a tumor-directed antibody, which exerts its antitumor activity through mechanisms such as direct killing (e.g., signaling-induced apoptosis), complement-dependent cytotoxicity (CDC), and/or antibody-dependent cell-mediated cytotoxicity (ADCC). In additional instances, the tumor-targeting agent elicits an adaptive immune response, with the induction of antitumor T cells.

In some embodiments, the binding moiety A is a tumor-directed polypeptide (e.g., a tumor-directed antibody). In some instances, the binding moiety A is a tumor-directed antibody, which exerts its antitumor activity through mechanisms such as direct killing (e.g., signaling-induced apoptosis), complement-dependent cytotoxicity (CDC), and/or antibody-dependent cell-mediated cytotoxicity (ADCC). In additional instances, the binding moiety A elicits an adaptive immune response, with the induction of antitumor T cells.

In some embodiments, the composition or a pharmaceutical formulation described herein comprises an immune-targeting agent. In some instances, the immune-targeting agent is encompassed by a binding moiety A. In other instances, the immune-targeting agent is an additional agent used in combination with a molecule of Formula (I). In some instances, the immune-targeting agent comprises cytokines, checkpoint inhibitors, or a combination thereof.

In some embodiments, the immune-targeting agent is a checkpoint inhibitor. In some cases, an immune checkpoint molecule is a molecule presented on the cell surface of CD4 and/or CD8 T cells. Exemplary immune checkpoint molecules include, but are not limited to, Programmed Death-Ligand 1 (PD-L1, also known as B7-H1, CD274), Programmed Death 1 (PD-1), CTLA-4, B7H1, B7H4, OX-40, CD137, CD40, 2B4, IDO1, IDO2, VISTA, CD27, CD28, PD-L2 (B7-DC, CD273), LAG3, CD80, CD86, PDL2, B7H3, HVEM, BTLA, KIR, GAL9, TIM3, A2aR, MARCO (macrophage receptor with collageneous structure), PS (phosphatidylserine), ICOS (inducible T cell costimulator), HAVCR2, CD276, VTCN1, CD70, and CD160.

In some instances, an immune checkpoint inhibitor refers to any molecule that modulates or inhibits the activity of an immune checkpoint molecule. In some instances, immune checkpoint inhibitors include antibodies, antibody-derivatives (e.g., Fab fragments, scFvs, minobodies, diabodies), antisense oligonucleotides, siRNA, aptamers, or peptides. In some embodiments, an immune checkpoint inhibitor is an inhibitor of Programmed Death-Ligand 1 (PD-L1, also known as B7-H1, CD274), Programmed Death 1 (PD-1), CTLA-4, PD-L2 (B7-DC, CD273), LAG3, TIM3, 2B4, A2aR, B7H1, B7H3, B7H4, BTLA, CD2, CD27, CD28, CD30, CD40, CD70, CD80, CD86, CD137, CD160, CD226, CD276, DR3, GAL9, GITR, HAVCR2, HVEM, IDO1, IDO2, ICOS (inducible T cell costimulator), KIR, LAIR1, LIGHT, MARCO (macrophage receptor with collageneous structure), PS (phosphatidylserine), OX-40, SLAM, TIGHT, VISTA, VTCN1, or any combinations thereof.

In some embodiments, exemplary checkpoint inhibitors include:

PD-L1 inhibitors such as Genentech's MPDL3280A (RG7446), Anti-mouse PD-L1 antibody Clone 10F.9G2 (Cat #BE0101) from BioXcell, anti-PD-L1 monoclonal antibody MDX-1105 (BMS-936559) and BMS-935559 from Bristol-Meyer's Squibb, MSB0010718C, mouse anti-PD-L1 Clone 29E.2A3, and AstraZeneca's MED14736;

PD-L2 inhibitors such as GlaxoSmithKline's AMP-224 (Amplimmune), and rHIgM12B7;

PD-1 inhibitors such as anti-mouse PD-1 antibody Clone J43 (Cat #BE0033-2) from BioXcell, anti-mouse PD-1 antibody Clone RMPI-14 (Cat #BE0146) from BioXcell, mouse anti-PD-1 antibody Clone EH12, Merck's MK-3475 anti-mouse PD-1 antibody (Keytruda, pembrolizumab, lambrolizumab), AnaptysBio's anti-PD-1 antibody known as ANB011, antibody MDX-1 106 (ONO-4538), Bristol-Myers Squibb's human IgG4 monoclonal antibody nivolumab (Opdivo®, BMS-936558, MDX1106), AstraZeneca's AMP-514 and AMP-224, and Pidilizumab (CT-011) from CureTech Ltd;

CTLA-4 inhibitors such as Bristol Meyers Squibb's anti-CTLA-4 antibody ipilimumab (also known as Yervoy®, MDX-010, BMS-734016 and MDX-101), anti-CTLA4 Antibody, clone 9H10 from Millipore, Pfizer's tremelimumab (CP-675,206, ticilimumab), and anti-CTLA4 antibody clone BNI3 from Abcam;

LAG3 inhibitors such as anti-Lag-3 antibody clone eBioC9B7W (C9B7W) from eBioscience, anti-Lag3 antibody LS-B2237 from LifeSpan Biosciences, IMP321 (ImmuFact) from Immutep, anti-Lag3 antibody BMS-986016, and the LAG-3 chimeric antibody A9H12;

B7-H3 inhibitors such as MGA271;

KIR inhibitors such as Lirilumab (IPH2101);

CD137 (41BB) inhibitors such as urelumab (BMS-663513, Bristol-Myers Squibb), PF-05082566 (anti-4-1BB, PF-2566, Pfizer), or XmAb-5592 (Xencor);

PS inhibitors such as Bavituximab; and inhibitors such as an antibody or fragments (e.g., a monoclonal antibody, a human, humanized, or chimeric antibody) thereof, RNAi molecules, or small molecules to TIM3, CD52, CD30, CD20, CD33, CD27, OX40 (CD134), GITR, ICOS, BTLA (CD272), CD160, 2B4, LAIR1, TIGHT, LIGHT, DR3, CD226, CD2, or SLAM.

In some embodiments, a binding moiety A comprising an immune checkpoint inhibitor is used for the treatment of a disease or disorder (e.g., cancer). In some instances, the binding moiety A is a bispecific antibody or a binding fragment thereof that comprises an immune checkpoint inhibitor. In some cases, a binding moiety A comprising an inhibitor of Programmed Death-Ligand 1 (PD-L1, also known as B7-H1, CD274), Programmed Death 1 (PD-1), CTLA-4, PD-L2 (B7-DC, CD273), LAG3, TIM3, 2B4, A2aR, B7H1, B7H3, B7H4, BTLA, CD2, CD27, CD28, CD30, CD40, CD70, CD80, CD86, CD137, CD160, CD226, CD276, DR3, GAL9, GITR, HAVCR2, HVEM, IDO1, IDO2, ICOS (inducible T cell costimulator), KIR, LAIR1, LIGHT, MARCO (macrophage receptor with collageneous structure), PS (phosphatidylserine), OX-40, SLAM, TIGHT, VISTA, VTCN1, or any combinations thereof, is used for the treatment of a disease or disorder (e.g., cancer).

In some embodiments, a molecule of Formula (I) in combination with an immune checkpoint inhibitor is used for the treatment of a disease or disorder (e.g., cancer). In some instances, the immune checkpoint inhibitor comprises an inhibitor of Programmed Death-Ligand 1 (PD-L1, also known as B7-H1, CD274), Programmed Death 1 (PD-1), CTLA-4, PD-L2 (B7-DC, CD273), LAG3, TIM3, 2B4, A2aR, B7H1, B7H3, B7H4, BTLA, CD2, CD27, CD28, CD30, CD40, CD70, CD80, CD86, CD137, CD160, CD226, CD276, DR3, GAL9, GITR, HAVCR2, HVEM, IDO1, IDO2, ICOS (inducible T cell costimulator), KIR, LAIR1, LIGHT, MARCO (macrophage receptor with collageneous structure), PS (phosphatidylserine), OX-40, SLAM, TIGHT, VISTA, VTCN1, or any combinations thereof. In some cases, a molecule of Formula (I) is used in combination with ipilimumab, tremelimumab, nivolumab, pemrolizumab, pidilizumab, MPDL3280A, MED14736, MSB0010718C, MK-3475, or BMS-936559, for the treatment of a disease or disorder (e.g., cancer).

In some embodiments, the immune-targeting agent is a cytokine. In some cases, cytokine is further subgrouped into chemokine, interferon, interleukin, and tumor necrosis factor. In some embodiments, chemokine plays a role as a chemoattractant to guide the migration of cells, and is classified into four subfamilies: CXC, CC, CX3C, and XC. Exemplary chemokines include chemokines from the CC subfamily: CCL1, CCL2 (MCP-1), CCL3, CCL4, CCL5 (RANTES), CCL6, CCL7, CCL8, CCL9 (or CCL10), CCL11, CCL12, CCL13, CCL14, CCL15, CCL16, CCL17, CCL18, CCL19, CCL20, CCL21, CCL22, CCL23, CCL24, CCL25, CCL26, CCL27, and CCL28; the CXC subfamily: CXCL1, CXCL2, CXCL3, CXCL4, CXCL5, CXCL6, CXCL7, CXCL8, CXCL9, CXCL10, CXCL11, CXCL12, CXCL13, CXCL14, CXCL15, CXCL16, and CXCL17; the XC subfamily: XCL1 and XCL2; and the CX3C subfamily CX3CL1.

Interferon (IFNs) comprises interferon type 1 (e.g., IFN-α, IFN-β, IFN-ε, IFN-κ, and IFN-ω), interferon type II (e.g. IFN-γ), and interferon type III. In some embodiments, IFN-α is further classified into about 13 subtypes which include IFNA1, IFNA2, IFNA4, IFNA5, IFNA6, IFNA7, IFNA8, IFNA10, IFNA13, IFNA14, IFNA16, IFNA17, and IFNA21.

Interleukin is expressed by leukocyte or white blood cell and promote the development and differentiation of T and B lymphocytes and hematopoietic cells. Exemplary interleukins include IL-1, IL-2, IL-3, IL-4, IL-5, IL-6, IL-7, IL-8 (CXCL8), IL-9, IL-10, IL-11, IL-12, IL-13, IL-14, IL-15, IL-16, IL-17, IL-18, IL-19, IL-20, IL-21, IL-22, IL-23, IL-24, IL-25, IL-26, IL-27, IL-28, IL-29, IL-30, IL-31, IL-32, IL-33, IL-35, and IL-36.

Tumor necrosis factors (TNFs) are a group of cytokines that modulate apoptosis. In some instances, there are about 19 members within the TNF family, including, not limited to, TNFα, lymphotoxin-alpha (LT-alpha), lymphotoxin-beta (LT-beta), T cell antigen gp39 (CD40L), CD27L, CD30L, FASL, 4-1BBL, OX40L, and TNF-related apoptosis inducing ligand (TRAIL).

In some embodiments, a molecule of Formula (I) in combination with a cytokine is used for the treatment of a disease or disorder (e.g., cancer). In some cases, a molecule of Formula (I) in combination with a chemokine is used for the treatment of a disease or disorder (e.g., cancer). In some cases, a molecule of Formula (I) in combination with an interferon is used for the treatment of a disease or disorder (e.g., cancer). In some cases, a molecule of Formula (I) in combination with an interleukin is used for the treatment of a disease or disorder (e.g., cancer). In some cases, a molecule of Formula (I) in combination with a tumor necrosis factor is used for the treatment of a disease or disorder (e.g., cancer). In some instances, a molecule of Formula (I) in combination with IL-1, IL-2, IL-7, IL-8, IL-15, MCP-1 (CCL2), MIP-1α, RANTES, MCP-3, MIP5, CCL19, CCL21, CXCL2, CXCL9, CXCL10, or CXCL11 is used for the treatment of a disease or disorder (e.g., cancer).

In some embodiments, the composition or a pharmaceutical formulation described herein comprises a vaccine. In some instances, the vaccine is an in situ vaccination. In some instances, the vaccine is a cell-based vaccine. In some instances, the vaccine is a non-cell based vaccine. In some instances, a molecule of Formula (I) in combination with dendritic cell-based vaccine is used for the treatment of a disease or disorder (e.g., cancer). In some instances, a molecule of Formula (I) in combination with tumor cell-based vaccine is used for the treatment of a disease or disorder (e.g., cancer). In some instances, a molecule of Formula (I) in combination with antigen vaccine is used for the treatment of a disease or disorder (e.g., cancer). In some instances, a molecule of Formula (I) in combination with anti-idiotype vaccine is used for the treatment of a disease or disorder (e.g., cancer). In some instances, a molecule of Formula (I) in combination with DNA vaccine is used for the treatment of a disease or disorder (e.g., cancer). In some instances, a molecule of Formula (I) in combination with vector-based vaccine is used for the treatment of a disease or disorder (e.g., cancer).

In some embodiments, a composition or a pharmaceutical formulation described herein is used as a passive immuno-oncology therapy method for the treatment of a disease or disorder (e.g., cancer). The passive method, in some instances, utilizes adoptive immune system components such as T cells, natural killer (NK) T cells, and/or chimeric antigen receptor (CAR) T cells generated exogenously to attack cancer cells.

In some embodiments, a molecule of Formula (I) in combination with a T-cell based therapeutic agent is used for the treatment of a disease or disorder (e.g., cancer). In some cases, the T-cell based therapeutic agent is an activated T-cell agent that recognizes one or more of a CD cell surface marker described above. In some instances, the T-cell based therapeutic agent comprises an activated T-cell agent that recognizes one or more of CD2, CD3, CD4, CD5, CD8, CD27, CD28, CD80, CD134, CD137, CD152, CD154, CD160, CD200R, CD223, CD226, CD244, CD258, CD267, CD272, CD274, CD278, CD279, or CD357. In some instances, a molecule of Formula (I) in combination with an activated T-cell agent recognizing one or more of CD2, CD3, CD4, CD5, CD8, CD27, CD28, CD80, CD134, CD137, CD152, CD154, CD160, CD200R, CD223, CD226, CD244, CD258, CD267, CD272, CD274, CD278, CD279, or CD357 is used for the treatment of a disease or disorder (e.g., cancer).

In some embodiments, a molecule of Formula (I) in combination with natural killer (NK) T cell-based therapeutic agent is used for the treatment of a disease or disorder (e.g., cancer). In some instances, the NK-based therapeutic agent is an activated NK agent that recognizes one or more of a CD cell surface marker described above. In some cases, the NK-based therapeutic agent is an activated NK agent that recognizes one or more of CD2, CD11a, CD11b, CD16, CD56, CD58, CD62L, CD85j, CD158a/b, CD158c, CD158e/f/k, CD158h/j, CD159a, CD162, CD226, CD314, CD335, CD337, CD244, or CD319. In some instances, a molecule of Formula (I) in combination with an activated NK agent recognizing one or more of CD2, CD11a, CD11b, CD16, CD56, CD58, CD62L, CD85j, CD158a/b, CD158c, CD158e/f/k, CD158h/j, CD159a, CD162, CD226, CD314, CD335, CD337, CD244, or CD319 is used for the treatment of a disease or disorder (e.g., cancer).

In some embodiments, a molecule of Formula (I) in combination with CAR-T cell-based therapeutic agent is used for the treatment of a disease or disorder (e.g., cancer).

In some embodiments, a molecule of Formula (I) in combination with an additional agent that destabilizes the endosomal membrane (or disrupts the endosomal-lysosomal membrane trafficking) is used for the treatment of a disease or disorder (e.g., cancer). In some instances, the additional agent comprises an antimitotic agent. Exemplary antimitotic agents include, but are not limited to, taxanes such as paclitaxel and docetaxel; vinca alkaloids such as vinblastine, vincristine, vindesine, and vinorelbine; cabazitaxel; colchicine; eribulin; estramustine; etoposide; ixabepilone; podophyllotoxin; teniposide; or griseofulvin. In some instances, the additional agent comprises paclitaxel, docetaxel, vinblastine, vincristine, vindesine, vinorelbine, cabazitaxel, colchicine, eribulin, estramustine, etoposide, ixabepilone, podophyllotoxin, teniposide, or griseofulvin. In some instances, the additional agent comprises taxol. In some instances, the additional agent comprises paclitaxel. In some instances, the additional agent comprises etoposide. In other instances, the additional agent comprises vitamin K3.

In some embodiments, a composition or a pharmaceutical formulation described herein is used as a combinatory method (including for both active and passive methods) in the treatment of a disease or disorder (e.g., cancer).

Muscle Dystrophy, Muscle Atrophy, Muscle Wasting

In one embodiment, muscle dystrophy refers to a significant loss in muscle strength. By significant loss in muscle strength is meant a reduction of strength in diseased, injured, or unused muscle tissue in a subject relative to the same muscle tissue in a control subject. In an embodiment, a significant loss in muscle strength is a reduction in strength of at least 10%, at least 15%, at least 20%, at least 25%, at least 30%, at least 35%, at least 40%, at least 45%, at least 50%, or more relative to the same muscle tissue in a control subject. In another embodiment, by significant loss in muscle strength is meant a reduction of strength in unused muscle tissue relative to the muscle strength of the same muscle tissue in the same subject prior to a period of nonuse. In an embodiment, a significant loss in muscle strength is a reduction of at least 10%, at least 15%, at least 20%, at least 25%, at least 30%, at least 35%, at least 40%, at least 45%, at least 50%, or more relative to the muscle strength of the same muscle tissue in the same subject prior to a period of nonuse.

In another embodiment, muscle dystrophy refers to a significant loss in muscle mass. By significant loss in muscle mass is meant a reduction of muscle volume in diseased, injured, or unused muscle tissue in a subject relative to the same muscle tissue in a control subject. In an embodiment, a significant loss of muscle volume is at least 10%, at least 15%, at least 20%, at least 25%, at least 30%, at least 35%, at least 40%, at least 45%, at least 50%, or more relative to the same muscle tissue in a control subject. In another embodiment, by significant loss in muscle mass is meant a reduction of muscle volume in unused muscle tissue relative to the muscle volume of the same muscle tissue in the same subject prior to a period of nonuse. In an embodiment, a significant loss in muscle tissue is at least 10%, at least 15%, at least 20%, at least 25%, at least 30%, at least 35%, at least 40%, at least 45%, at least 50%, or more relative to the muscle volume of the same muscle tissue in the same subject prior to a period of nonuse. Muscle volume is optionally measured by evaluating the cross-section area of a muscle such as by Magnetic Resonance Imaging (e.g., by a muscle volume/cross-section area (CSA) MRI method).

Myotonic dystrophy is a multisystemic neuromuscular disease comprising two main types: myotonic dystrophy type 1 (DM1) and myotonic dystrophy type 2 (DM2). DM1 is caused by a dominantly inherited "CTG" repeat expansion in the gene DM protein kinase (DMPK), which when transcribed into mRNA, forms hairpins that bind with high affinity to the Muscleblind-like (MBNL) family of proteins. MBNL proteins are involved in post-transcriptional splicing and polyadenylatin site regulation and loss of the MBNL protein functions lead to downstream accumulation of nuclear foci and increase in mis-splicing events and subsequently to myotonia and other clinical symptoms.

In some embodiments, described herein is a method of treating muscle dystrophy, muscle atrophy, and/or muscle wasting in a subject, which comprises providing a polynucleic acid molecule described herein or a polynucleic acid molecule conjugate described herein and administering to the subject a therapeutically effective amount of the polynucleic acid molecule or polynucleic acid molecule conjugate to the subject in need thereof to treat the muscular dystrophy muscle atrophy, and/or muscle wasting. In some embodiments, the polynucleic acid molecules or polynucleic acid molecule conjugates target a gene transcripts that are mutated or upregulated such that downregulation, deletion, exon skipping of transcripts are desired to treat the diseases. In some embodiments, the polynucleic acid molecules or polynucleic acid molecule conjugates target DMPK mRNA, DMD mRNA, or GYS1 mRNA.

Pharmaceutical Formulation

In some embodiments, the pharmaceutical formulations described herein are administered to a subject by multiple administration routes, including but not limited to, parenteral (e.g., intravenous, subcutaneous, intramuscular), oral, intranasal, buccal, rectal, or transdermal administration routes. In some instances, the pharmaceutical composition describe herein is formulated for parenteral (e.g., intravenous, subcutaneous, intramuscular) administration. In other instances, the pharmaceutical composition describe herein is formulated for oral administration. In still other instances, the pharmaceutical composition describe herein is formulated for intranasal administration.

In some embodiments, the pharmaceutical formulations include, but are not limited to, aqueous liquid dispersions, self-emulsifying dispersions, solid solutions, liposomal dispersions, aerosols, solid dosage forms, powders, immediate-release formulations, controlled-release formulations, fast melt formulations, tablets, capsules, pills, delayed release formulations, extended release formulations, pulsatile release formulations, multiparticulate formulations (e.g., nanoparticle formulations), and mixed immediate and controlled release formulations.

In some instances, the pharmaceutical formulation includes multiparticulate formulations. In some instances, the pharmaceutical formulation includes nanoparticle formulations. In some instances, nanoparticles comprise cMAP, cyclodextrin, or lipids. In some cases, nanoparticles comprise solid lipid nanoparticles, polymeric nanoparticles, self-emulsifying nanoparticles, liposomes, microemulsions, or micellar solutions. Additional exemplary nanoparticles include, but are not limited to, paramagnetic nanoparticles, superparamagnetic nanoparticles, metal nanoparticles, fullerene-like materials, inorganic nanotubes, dendrimers (such as with covalently attached metal chelates), nanofibers, nanohorns, nano-onions, nanorods, nanoropes and quantum dots. In some instances, a nanoparticle is a metal nanoparticle, e.g., a nanoparticle of scandium, titanium, vanadium, chromium, manganese, iron, cobalt, nickel, copper, zinc, yttrium, zirconium, niobium, molybdenum, ruthenium, rhodium, palladium, silver, cadmium, hafnium, tantalum, tungsten, rhenium, osmium, iridium, platinum, gold, gadolinium, aluminum, gallium, indium, tin, thallium, lead, bismuth, magnesium, calcium, strontium, barium, lithium, sodium, potassium, boron, silicon, phosphorus, germanium, arsenic, antimony, and combinations, alloys or oxides thereof.

In some instances, a nanoparticle includes a core or a core and a shell, as in a core-shell nanoparticle.

In some instances, a nanoparticle is further coated with molecules for attachment of functional elements (e.g., with one or more of a polynucleic acid molecule or binding moiety described herein). In some instances, a coating comprises chondroitin sulfate, dextran sulfate, carboxymethyl dextran, alginic acid, pectin, carragheenan, fucoidan, agaropectin, porphyran, karaya gum, gellan gum, xanthan gum, hyaluronic acids, glucosamine, galactosamine, chitin (or chitosan), polyglutamic acid, polyaspartic acid, lysozyme, cytochrome C, ribonuclease, trypsinogen, chymotrypsinogen, α-chymotrypsin, polylysine, polyarginine, histone, protamine, ovalbumin, dextrin, or cyclodextrin. In some instances, a nanoparticle comprises a graphene-coated nanoparticle.

In some cases, a nanoparticle has at least one dimension of less than about 500 nm, 400 nm, 300 nm, 200 nm, or 100 nm.

In some instances, the nanoparticle formulation comprises paramagnetic nanoparticles, superparamagnetic nanoparticles, metal nanoparticles, fullerene-like materials, inorganic nanotubes, dendrimers (such as with covalently attached metal chelates), nanofibers, nanohorns, nano-onions, nanorods, nanoropes or quantum dots. In some instances, a polynucleic acid molecule or a binding moiety described herein is conjugated either directly or indirectly to the nanoparticle. In some instances, at least 1, 5, 10, 15, 20, 30, 40, 50, 60, 70, 80, 90, 100, or more polynucleic acid molecules or binding moieties described herein are conjugated either directly or indirectly to a nanoparticle.

In some embodiments, the pharmaceutical formulations include a carrier or carrier materials selected on the basis of compatibility with the composition disclosed herein, and the release profile properties of the desired dosage form. Exemplary carrier materials include, e.g., binders, suspending agents, disintegration agents, filling agents, surfactants, solubilizers, stabilizers, lubricants, wetting agents, diluents, and the like. Pharmaceutically compatible carrier materials include, but are not limited to, acacia, gelatin, colloidal silicon dioxide, calcium glycerophosphate, calcium lactate, maltodextrin, glycerine, magnesium silicate, polyvinylpyrrollidone (PVP), cholesterol, cholesterol esters, sodium caseinate, soy lecithin, taurocholic acid, phosphotidylcholine, sodium chloride, tricalcium phosphate, dipotassium phosphate, cellulose and cellulose conjugates, sugars sodium stearoyl lactylate, carrageenan, monoglyceride, diglyceride, pregelatinized starch, and the like. See, e.g., *Remington: The Science and Practice of Pharmacy*, Nineteenth Ed (Easton, Pa.: Mack Publishing Company, 1995); Hoover, John E., *Remington's Pharmaceutical Sciences*, Mack Publishing Co., Easton, Pennsylvania 1975; Liberman, H. A. and Lachman, L., Eds., *Pharmaceutical Dosage Forms*, Marcel Decker, New York, N.Y., 1980; and *Pharmaceutical Dosage Forms and Drug Delivery Systems*, Seventh Ed. (Lippincott Williams & Wilkins 1999).

In some instances, the pharmaceutical formulations further include pH-adjusting agents or buffering agents which include acids such as acetic, boric, citric, lactic, phosphoric and hydrochloric acids; bases such as sodium hydroxide, sodium phosphate, sodium borate, sodium citrate, sodium acetate, sodium lactate and tris-hydroxymethylaminomethane; and buffers such as citrate/dextrose, sodium bicarbonate and ammonium chloride. Such acids, bases and buffers are included in an amount required to maintain pH of the composition in an acceptable range.

In some instances, the pharmaceutical formulation includes one or more salts in an amount required to bring osmolality of the composition into an acceptable range. Such salts include those having sodium, potassium or ammonium cations and chloride, citrate, ascorbate, borate, phosphate, bicarbonate, sulfate, thiosulfate or bisulfite anions; suitable salts include sodium chloride, potassium chloride, sodium thiosulfate, sodium bisulfite and ammonium sulfate.

In some instances, the pharmaceutical formulations further include diluent which are used to stabilize compounds because they can provide a more stable environment. Salts dissolved in buffered solutions (which also can provide pH control or maintenance) are utilized as diluents in the art, including, but not limited to a phosphate buffered saline solution. In certain instances, diluents increase bulk of the composition to facilitate compression or create sufficient bulk for homogenous blend for capsule filling. Such compounds can include e.g., lactose, starch, mannitol, sorbitol, dextrose, microcrystalline cellulose such as Avicel®; dibasic calcium phosphate, dicalcium phosphate dihydrate; tricalcium phosphate, calcium phosphate; anhydrous lactose, spray-dried lactose; pregelatinized starch, compressible sugar, such as Di-Pac® (Amstar); mannitol, hydroxypropylmethylcellulose, hydroxypropylmethylcellulose acetate stearate, sucrose-based diluents, confectioner's sugar; monobasic calcium sulfate monohydrate, calcium sulfate dihydrate; calcium lactate trihydrate, dextrates; hydrolyzed cereal solids, amylose; powdered cellulose, calcium carbonate; glycine, kaolin; mannitol, sodium chloride; inositol, bentonite, and the like.

In some cases, the pharmaceutical formulations include disintegration agents or disintegrants to facilitate the breakup or disintegration of a substance. The term "disintegrate" include both the dissolution and dispersion of the dosage form when contacted with gastrointestinal fluid. Examples of disintegration agents include a starch, e.g., a natural starch such as corn starch or potato starch, a pregelatinized starch such as National 1551 or Amijel®, or sodium starch glycolate such as Promogel® or Explotab®, a cellulose such as a wood product, methylcrystalline cellulose, e.g., Avicel®, Avicel® PH101, Avicel® PH102, Avicel® PH105, Elcema® P100, Emcocel®, Vivacel®, Ming Tia®, and Solka-Floc®, methylcellulose, croscarmellose, or a cross-linked cellulose, such as cross-linked sodium carboxymethylcellulose (Ac-Di-Sol®), cross-linked carboxymethylcellulose, or cross-linked croscarmellose, a cross-linked starch such as sodium starch glycolate, a cross-linked polymer such as crospovidone, a cross-linked polyvinylpyrrolidone, alginate such as alginic acid or a salt of alginic acid such as sodium alginate, a clay such as Veegum® HV (magnesium aluminum silicate), a gum such as agar, guar, locust bean, Karaya, pectin, or tragacanth, sodium starch glycolate, bentonite, a natural sponge, a surfactant, a resin such as a cation-exchange resin, citrus pulp, sodium lauryl sulfate, sodium lauryl sulfate in combination starch, and the like.

In some instances, the pharmaceutical formulations include filling agents such as lactose, calcium carbonate, calcium phosphate, dibasic calcium phosphate, calcium sulfate, microcrystalline cellulose, cellulose powder, dextrose, dextrates, dextran, starches, pregelatinized starch, sucrose, xylitol, lactitol, mannitol, sorbitol, sodium chloride, polyethylene glycol, and the like.

Lubricants and glidants are also optionally included in the pharmaceutical formulations described herein for preventing, reducing or inhibiting adhesion or friction of materials. Exemplary lubricants include, e.g., stearic acid, calcium hydroxide, talc, sodium stearyl fumerate, a hydrocarbon such as mineral oil, or hydrogenated vegetable oil such as hydrogenated soybean oil (Sterotex®), higher fatty acids and their alkali-metal and alkaline earth metal salts, such as aluminum, calcium, magnesium, zinc, stearic acid, sodium stearates, glycerol, talc, waxes, Stearowet®, boric acid, sodium benzoate, sodium acetate, sodium chloride, leucine, a polyethylene glycol (e.g., PEG-4000) or a methoxypolyethylene glycol such as Carbowax™, sodium oleate, sodium benzoate, glyceryl behenate, polyethylene glycol, magnesium or sodium lauryl sulfate, colloidal silica such as Syloid™, Cab-O-Sil®, a starch such as corn starch, silicone oil, a surfactant, and the like.

Plasticizers include compounds used to soften the microencapsulation material or film coatings to make them less brittle. Suitable plasticizers include, e.g., polyethylene glycols such as PEG 300, PEG 400, PEG 600, PEG 1450, PEG 3350, and PEG 800, stearic acid, propylene glycol, oleic acid, triethyl cellulose and triacetin. Plasticizers can also function as dispersing agents or wetting agents.

Solubilizers include compounds such as triacetin, triethylcitrate, ethyl oleate, ethyl caprylate, sodium lauryl sulfate, sodium doccusate, vitamin E TPGS, dimethylacetamide, N-methylpyrrolidone, N-hydroxyethylpyrrolidone, polyvinylpyrrolidone, hydroxypropylmethyl cellulose, hydroxypropyl cyclodextrins, ethanol, n-butanol, isopropyl alcohol, cholesterol, bile salts, polyethylene glycol 200-600, glycofurol, transcutol, propylene glycol, dimethyl isosorbide, and the like.

Stabilizers include compounds such as any antioxidation agents, buffers, acids, preservatives and the like.

Suspending agents include compounds such as polyvinylpyrrolidone, e.g., polyvinylpyrrolidone K12, polyvinylpyrrolidone K17, polyvinylpyrrolidone K25, or polyvinylpyrrolidone K30, vinyl pyrrolidone/vinyl acetate copolymer (S630), polyethylene glycol, e.g., the polyethylene glycol can have a molecular weight of about 300 to about 6000, or about 3350 to about 4000, or about 7000 to about 5400, sodium carboxymethylcellulose, methylcellulose, hydroxypropylmethylcellulose, hydroxymethylcellulose acetate stearate, polysorbate-80, hydroxyethylcellulose, sodium alginate, gums, such as, e.g., gum tragacanth and gum acacia, guar gum, xanthans, including xanthan gum, sugars, cellulosics, such as, e.g., sodium carboxymethylcellulose, methylcellulose, sodium carboxymethylcellulose, hydroxypropylmethylcellulose, hydroxyethylcellulose, polysorbate-80, sodium alginate, polyethoxylated sorbitan monolaurate, polyethoxylated sorbitan monolaurate, povidone and the like.

Surfactants include compounds such as sodium lauryl sulfate, sodium docusate, Tween 60 or 80, triacetin, vitamin E TPGS, sorbitan monooleate, polyoxyethylene sorbitan monooleate, polysorbates, polaxomers, bile salts, glyceryl monostearate, copolymers of ethylene oxide and propylene oxide, e.g., Pluronic® (BASF), and the like. Additional surfactants include polyoxyethylene fatty acid glycerides and vegetable oils, e.g., polyoxyethylene (60) hydrogenated castor oil; and polyoxyethylene alkylethers and alkylphenyl ethers, e.g., octoxynol 10, octoxynol 40. Sometimes, surfactants is included to enhance physical stability or for other purposes.

Viscosity enhancing agents include, e.g., methyl cellulose, xanthan gum, carboxymethyl cellulose, hydroxypropyl cellulose, hydroxypropylmethyl cellulose, hydroxypropylmethyl cellulose acetate stearate, hydroxypropylmethyl cellulose phthalate, carbomer, polyvinyl alcohol, alginates, acacia, chitosans and combinations thereof.

Wetting agents include compounds such as oleic acid, glyceryl monostearate, sorbitan monooleate, sorbitan monolaurate, triethanolamine oleate, polyoxyethylene sorbitan monooleate, polyoxyethylene sorbitan monolaurate, sodium docusate, sodium oleate, sodium lauryl sulfate, sodium doccusate, triacetin, Tween 80, vitamin E TPGS, ammonium salts and the like.

Therapeutic Regimens

In some embodiments, the pharmaceutical compositions described herein are administered for therapeutic applications. In some embodiments, the pharmaceutical composition is administered once per day, twice per day, three times per day or more. The pharmaceutical composition is administered daily, every day, every alternate day, five days a week, once a week, every other week, two weeks per month, three weeks per month, once a month, twice a month, three times per month, or more. The pharmaceutical composition is administered for at least 1 month, 2 months, 3 months, 4 months, 5 months, 6 months, 7 months, 8 months, 9 months, 10 months, 11 months, 12 months, 18 months, 2 years, 3 years, or more.

In some embodiments, one or more pharmaceutical compositions are administered simultaneously, sequentially, or at an interval period of time. In some embodiments, one or more pharmaceutical compositions are administered simultaneously. In some cases, one or more pharmaceutical compositions are administered sequentially. In additional cases, one or more pharmaceutical compositions are administered at an interval period of time (e.g., the first administration of a first pharmaceutical composition is on day one followed by an interval of at least 1, 2, 3, 4, 5, or more days prior to the administration of at least a second pharmaceutical composition).

In some embodiments, two or more different pharmaceutical compositions are coadministered. In some instances, the two or more different pharmaceutical compositions are coadministered simultaneously. In some cases, the two or more different pharmaceutical compositions are coadministered sequentially without a gap of time between administrations. In other cases, the two or more different pharmaceutical compositions are coadministered sequentially with a gap of about 0.5 hour, 1 hour, 2 hour, 3 hour, 12 hours, 1 day, 2 days, or more between administrations.

In the case wherein the patient's status does improve, upon the doctor's discretion the administration of the composition is given continuously; alternatively, the dose of the composition being administered is temporarily reduced or temporarily suspended for a certain length of time (i.e., a "drug holiday"). In some instances, the length of the drug holiday varies between 2 days and 1 year, including by way of example only, 2 days, 3 days, 4 days, 5 days, 6 days, 7 days, 10 days, 12 days, 15 days, 20 days, 28 days, 35 days, 50 days, 70 days, 100 days, 120 days, 150 days, 180 days, 200 days, 250 days, 280 days, 300 days, 320 days, 350 days, or 365 days. The dose reduction during a drug holiday is from 10%-100%, including, by way of example only, 10%, 15%, 20%, 25%, 30%, 35%, 40%, 45%, 50%, 55%, 60%, 65%, 70%, 75%, 80%, 85%, 90%, 95%, or 100%.

Once improvement of the patient's conditions has occurred, a maintenance dose is administered if necessary. Subsequently, the dosage or the frequency of administration, or both, are optionally reduced, as a function of the symptoms, to a level at which the improved disease, disorder or condition is retained.

In some embodiments, the amount of a given agent that correspond to such an amount varies depending upon factors such as the particular compound, the severity of the disease, the identity (e.g., weight) of the subject or host in need of treatment, but nevertheless is routinely determined in a manner known in the art according to the particular circumstances surrounding the case, including, e.g., the specific agent being administered, the route of administration, and the subject or host being treated. In some instances, the desired dose is conveniently presented in a single dose or as divided doses administered simultaneously (or over a short period of time) or at appropriate intervals, for example as two, three, four or more sub-doses per day.

The foregoing ranges are merely suggestive, as the number of variables in regard to an individual treatment regime is large, and considerable excursions from these recommended values are not uncommon. Such dosages are altered depending on a number of variables, not limited to the activity of the compound used, the disease or condition to be treated, the mode of administration, the requirements of the individual subject, the severity of the disease or condition being treated, and the judgment of the practitioner.

In some embodiments, toxicity and therapeutic efficacy of such therapeutic regimens are determined by standard pharmaceutical procedures in cell cultures or experimental animals, including, but not limited to, the determination of the LD50 (the dose lethal to 50% of the population) and the ED50 (the dose therapeutically effective in 50% of the population). The dose ratio between the toxic and therapeutic effects is the therapeutic index and it is expressed as the ratio between LD50 and ED50. Compounds exhibiting high therapeutic indices are preferred. The data obtained from cell culture assays and animal studies are used in formulating a range of dosage for use in human. The dosage of such compounds lies preferably within a range of circulating concentrations that include the ED50 with minimal toxicity. The dosage varies within this range depending upon the dosage form employed and the route of administration utilized.

Kits/Article of Manufacture

Disclosed herein, in certain embodiments, are kits and articles of manufacture for use with one or more of the compositions and methods described herein. Such kits include a carrier, package, or container that is compartmentalized to receive one or more containers such as vials, tubes, and the like, each of the container(s) comprising one of the separate elements to be used in a method described herein. Suitable containers include, for example, bottles, vials, syringes, and test tubes. In one embodiment, the containers are formed from a variety of materials such as glass or plastic.

The articles of manufacture provided herein contain packaging materials. Examples of pharmaceutical packaging materials include, but are not limited to, blister packs, bottles, tubes, bags, containers, bottles, and any packaging material suitable for a selected formulation and intended mode of administration and treatment.

For example, the container(s) include a molecule of Formula (Xa): A-X-B'-Y-C, as disclosed herein. Such kits optionally include an identifying description or label or instructions relating to its use in the methods described herein.

A kit typically includes labels listing contents and/or instructions for use and package inserts with instructions for use. A set of instructions will also typically be included.

In one embodiment, a label is on or associated with the container. In one embodiment, a label is on a container when letters, numbers, or other characters forming the label are attached, molded or etched into the container itself; a label is associated with a container when it is present within a receptacle or carrier that also holds the container, e.g., as a package insert. In one embodiment, a label is used to indicate that the contents are to be used for a specific therapeutic application. The label also indicates directions for use of the contents, such as in the methods described herein.

In certain embodiments, the pharmaceutical compositions are presented in a pack or dispenser device which contains one or more unit dosage forms containing a compound provided herein. The pack, for example, contains metal or plastic foil, such as a blister pack. In one embodiment, the pack or dispenser device is accompanied by instructions for administration. In one embodiment, the pack or dispenser is also accompanied with a notice associated with the container in form prescribed by a governmental agency regulating the manufacture, use, or sale of pharmaceuticals, which notice is reflective of approval by the agency of the form of the drug for human or veterinary administration. Such notice, for example, is the labeling approved by the U.S. Food and Drug Administration for prescription drugs, or the approved product insert. In one embodiment, compositions containing a compound provided herein formulated in a compatible pharmaceutical carrier are also prepared, placed in an appropriate container, and labeled for treatment of an indicated condition.

Certain Terminology

Unless defined otherwise, all technical and scientific terms used herein have the same meaning as is commonly understood by one of skill in the art to which the claimed subject matter belongs. It is to be understood that the foregoing general description and the following detailed description are exemplary and explanatory only and are not restrictive of any subject matter claimed. In this application, the use of the singular includes the plural unless specifically stated otherwise. It must be noted that, as used in the specification and the appended claims, the singular forms "a," "an" and "the" include plural referents unless the context clearly dictates otherwise. In this application, the use of "or" means "and/or" unless stated otherwise. Furthermore, use of the term "including" as well as other forms, such as "include", "includes," and "included," is not limiting.

As used herein, ranges and amounts can be expressed as "about" a particular value or range. About also includes the exact amount. Hence "about 5 µL" means "about 5 µL" and also "5 µL." Generally, the term "about" includes an amount that is expected to be within experimental error.

The section headings used herein are for organizational purposes only and are not to be construed as limiting the subject matter described.

As used herein, the terms "individual(s)", "subject(s)" and "patient(s)" mean any mammal. In some embodiments, the mammal is a human. In some embodiments, the mammal is a non-human. None of the terms require or are limited to situations characterized by the supervision (e.g. constant or intermittent) of a health care worker (e.g. a doctor, a registered nurse, a nurse practitioner, a physician's assistant, an orderly or a hospice worker).

Chemical Definitions

The abbreviations used herein have their conventional meaning within the chemical and biological arts. The chemical structures and formulae set forth herein are constructed according to the standard rules of chemical valency known in the chemical arts.

Where substituent groups are specified by their conventional chemical formulae, written from left to right, they equally encompass the chemically identical substituents that would result from writing the structure from right to left, e.g., —$CH_2O$— is equivalent to —$OCH_2$—.

The term "alkyl," by itself or as part of another substituent, means, unless otherwise stated, a straight (i.e., unbranched) or branched carbon chain (or carbon), or combination thereof, which may be fully saturated, mono- or polyunsaturated and can include mono-, di- and multivalent radicals, having the number of carbon atoms designated (i.e., $C_1$-$C_{10}$ means one to ten carbons). Alkyl is an uncyclized chain. Examples of saturated hydrocarbon radicals include, but are not limited to, groups such as methyl, ethyl, n-propyl, isopropyl, n-butyl, t-butyl, isobutyl, sec-butyl, (cyclohexyl) methyl, homologs and isomers of, for example, n-pentyl, n-hexyl, n-heptyl, n-octyl, and the like. An unsaturated alkyl group is one having one or more double bonds or triple bonds. Examples of unsaturated alkyl groups include, but are not limited to, vinyl, 2-propenyl, crotyl, 2-isopentenyl, 2-(butadienyl), 2,4-pentadienyl, 3-(1,4-pentadienyl), ethynyl, 1- and 3-propynyl, 3-butynyl, and the higher homologs and isomers. An alkoxy is an alkyl attached to the remainder of the molecule via an oxygen linker (—O—).

The term "alkylene," by itself or as part of another substituent, means, unless otherwise stated, a divalent radical derived from an alkyl, as exemplified, but not limited by, —$CH_2CH_2CH_2CH_2$—. Typically, an alkyl (or alkylene) group will have from 1 to 24 carbon atoms, with those groups having 10 or fewer carbon atoms being preferred herein. A "lower alkyl" or "lower alkylene" is a shorter chain alkyl or alkylene group, generally having eight or fewer carbon atoms. The term "alkenylene," by itself or as part of another substituent, means, unless otherwise stated, a divalent radical derived from an alkene.

The term "heteroalkyl," by itself or in combination with another term, means, unless otherwise stated, a stable straight or branched chain, or combinations thereof, including at least one carbon atom and at least one heteroatom (e.g., O, N, P, Si, and S), and wherein the nitrogen and sulfur atoms may optionally be oxidized, and the nitrogen heteroatom may optionally be quaternized. The heteroatom(s) (e.g., N, S, Si, or P) may be placed at any interior position of the heteroalkyl group or at the position at which the alkyl group is attached to the remainder of the molecule. Heteroalkyl is an uncyclized chain. Examples include, but are not limited to: —$CH_2$—$CH_2$—O—$CH_3$, —$CH_2$—$CH_2$—NH—$CH_3$, —$CH_2$—$CH_2$—N($CH_3$)—$CH_3$, —$CH_2$—S—$CH_2$—$CH_3$, —$CH_2$—$CH_2$, —S(O)—$CH_3$, —$CH_2$—$CH_2$—S(O)2—$CH_3$, —CH=CH—O—$CH_3$, —Si($CH_3$)$_3$, —$CH_2$—CH=N—$OCH_3$, —CH=CH—N($CH_3$)—$CH_3$, —O—$CH_3$, —O—$CH_2$—$CH_3$, and —CN. Up to two or three heteroatoms may be consecutive, such as, for example, —$CH_2$—NH—$OCH_3$ and —$CH_2$—O—Si($CH_3$)$_3$. A heteroalkyl moiety may include one heteroatom (e.g., O, N, S, Si, or P). A heteroalkyl moiety may include two optionally different heteroatoms (e.g., O, N, S, Si, or P). A heteroalkyl moiety may include three optionally different heteroatoms (e.g., O, N, S, Si, or P). A heteroalkyl moiety may include four optionally different heteroatoms (e.g., O, N, S, Si, or P). A heteroalkyl moiety may include five optionally different heteroatoms (e.g., O, N, S, Si, or P). A heteroalkyl moiety may include up to 8 optionally different heteroatoms (e.g., O, N, S, Si, or P).

Similarly, the term "heteroalkylene," by itself or as part of another substituent, means, unless otherwise stated, a divalent radical derived from heteroalkyl, as exemplified, but not limited by, —$CH_2$—$CH_2$—S—$CH_2$—$CH_2$—and —$CH_2$—S—$CH_2$—$CH_2$—NH—$CH_2$—. For heteroalkylene groups, heteroatoms can also occupy either or both of the chain termini (e.g., alkyleneoxy, alkylenedioxy, alkyleneamino, alkylenediamino, and the like). Still further, for alkylene and heteroalkylene linking groups, no orientation of the linking group is implied by the direction in which the formula of the linking group is written. For example, the formula —C(O) 2R'— represents both —C(O)2R'— and —R'C(O)$_2$—. As described above, heteroalkyl groups, as used herein, include those groups that are attached to the remainder of the molecule through a heteroatom, such as —C(O)R', —C(O) NR', —NR'R", —OR', —SR', and/or —SO$_2$R'. Where "heteroalkyl" is recited, followed by recitations of specific heteroalkyl groups, such as —NR'R" or the like, it will be understood that the terms heteroalkyl and —NR'R" are not redundant or mutually exclusive. Rather, the specific heteroalkyl groups are recited to add clarity. Thus, the term "heteroalkyl" should not be interpreted herein as excluding specific heteroalkyl groups, such as —NR'R" or the like.

The terms "cycloalkyl" and "heterocycloalkyl," by themselves or in combination with other terms, mean, unless otherwise stated, cyclic versions of "alkyl" and "heteroalkyl," respectively. Cycloalkyl and heterocycloalkyl are not aromatic. Additionally, for heterocycloalkyl, a heteroatom can occupy the position at which the heterocycle is attached to the remainder of the molecule. Examples of cycloalkyl include, but are not limited to, cyclopropyl, cyclobutyl, cyclopentyl, cyclohexyl, 1-cyclohexenyl, 3-cyclohexenyl, cycloheptyl, and the like. Examples of heterocycloalkyl include, but are not limited to, 1-(1,2,5,6-tetrahydropyridyl), 1-piperidinyl, 2-piperidinyl, 3-piperidinyl, 4-morpholinyl, 3-morpholinyl, tetrahydrofuran-2-yl, tetrahydrofuran-3-yl, tetrahydrothien-2-yl, tetrahydrothien-3-yl, 1-piperazinyl, 2-piperazinyl, and the like. A "cycloalkylene" and a "heterocycloalkylene," alone or as part of another substituent, means a divalent radical derived from a cycloalkyl and heterocycloalkyl, respectively. "Cycloalkyl" is also meant to refer to bicyclic and polycyclic hydrocarbon rings such as, for example, bicyclo[2.2.1]heptane, bicyclo[2.2.2]octane, etc.

The terms "halo" or "halogen," by themselves or as part of another substituent, mean, unless otherwise stated, a fluorine, chlorine, bromine, or iodine atom. Additionally, terms such as "haloalkyl" are meant to include monohaloalkyl and polyhaloalkyl. For example, the term "halo($C_1$-$C_4$) alkyl" includes, but is not limited to, fluoromethyl, difluoromethyl, trifluoromethyl, 2,2,2-trifluoroethyl, 4-chlorobutyl, 3-bromopropyl, and the like.

The term "acyl" means, unless otherwise stated, —C(O)R where R is a substituted or unsubstituted alkyl, substituted or unsubstituted cycloalkyl, substituted or unsubstituted heteroalkyl, substituted or unsubstituted heterocycloalkyl, substituted or unsubstituted aryl, or substituted or unsubstituted heteroaryl.

The term "aryl" means, unless otherwise stated, a polyunsaturated, aromatic, hydrocarbon substituent, which can be a single ring or multiple rings (preferably from 1 to 3 rings) that are fused together (i.e., a fused ring aryl) or linked covalently. A fused ring aryl refers to multiple rings fused together wherein at least one of the fused rings is an aryl ring. The term "heteroaryl" refers to aryl groups (or rings) that contain at least one heteroatom such as N, O, or S, wherein the nitrogen and sulfur atoms are optionally oxidized, and the nitrogen atom(s) are optionally quaternized. Thus, the term "heteroaryl" includes fused ring heteroaryl groups (i.e., multiple rings fused together wherein at least one of the fused rings is a heteroaromatic ring). A 5,6-fused ring heteroarylene refers to two rings fused together, wherein one ring has 5 members and the other ring has 6 members, and wherein at least one ring is a heteroaryl ring. Likewise, a 6,6-fused ring heteroarylene refers to two rings fused together, wherein one ring has 6 members and the other ring has 6 members, and wherein at least one ring is a heteroaryl ring. And a 6,5-fused ring heteroarylene refers to two rings fused together, wherein one ring has 6 members and the other ring has 5 members, and wherein at least one ring is a heteroaryl ring. A heteroaryl group can be attached to the remainder of the molecule through a carbon or heteroatom. Non-limiting examples of aryl and heteroaryl groups include phenyl, naphthyl, pyrrolyl, pyrazolyl, pyridazinyl, triazinyl, pyrimidinyl, imidazolyl, pyrazinyl, purinyl, oxazolyl, isoxazolyl, thiazolyl, furyl, thienyl, pyridyl, pyrimidyl, benzothiazolyl, benzoxazoyl benzimidazolyl, benzofuran, isobenzofuranyl, indolyl, isoindolyl, benzothiophenyl, isoquinolyl, quinoxalinyl, quinolyl, 1-naphthyl, 2-naphthyl, 4-biphenyl, 1-pyrrolyl, 2-pyrrolyl, 3-pyrrolyl, 3-pyrazolyl, 2-imidazolyl, 4-imidazolyl, pyrazinyl, 2-oxazolyl, 4-oxazolyl, 2-phenyl-4-oxazolyl, 5-oxazolyl, 3-isoxazolyl, 4-isoxazolyl, 5-isoxazolyl, 2-thiazolyl, 4-thiazolyl, 5-thiazolyl, 2-furyl, 3-furyl, 2-thienyl, 3-thienyl, 2-pyridyl, 3-pyridyl, 4-pyridyl, 2-pyrimidyl, 4-pyrimidyl, 5-benzothiazolyl, purinyl, 2-benzimidazolyl, 5-indolyl, 1-isoquinolyl, 5-isoquinolyl, 2-quinoxalinyl, 5-quinoxalinyl, 3-quinolyl, and 6-quinolyl. Substituents for each of the above noted aryl and heteroaryl ring systems are selected from the group of acceptable substituents described below. An "arylene" and a "heteroarylene," alone or as part of another substituent, mean a divalent radical derived from an aryl and heteroaryl, respectively. A heteroaryl group substituent may be —O— bonded to a ring heteroatom nitrogen.

Spirocyclic rings are two or more rings wherein adjacent rings are attached through a single atom. The individual rings within spirocyclic rings may be identical or different. Individual rings in spirocyclic rings may be substituted or unsubstituted and may have different substituents from other individual rings within a set of spirocyclic rings. Possible substituents for individual rings within spirocyclic rings are the possible substituents for the same ring when not part of spirocyclic rings (e.g. substituents for cycloalkyl or heterocycloalkyl rings). Spirocyclic rings may be substituted or unsubstituted cycloalkyl, substituted or unsubstituted cycloalkylene, substituted or unsubstituted heterocycloalkyl or substituted or unsubstituted heterocycloalkylene and individual rings within a spirocyclic ring group may be any of the immediately previous list, including having all rings of one type (e.g. all rings being substituted heterocycloalkylene wherein each ring may be the same or different substituted heterocycloalkylene). When referring to a spirocyclic ring system, heterocyclic spirocyclic rings means a spirocyclic rings wherein at least one ring is a heterocyclic ring and wherein each ring may be a different ring. When referring to a spirocyclic ring system, substituted spirocyclic rings means that at least one ring is substituted and each substituent may optionally be different.

The symbol ⌇⌇⌇ denotes the point of attachment of a chemical moiety to the remainder of a molecule or chemical formula.

The term "oxo," as used herein, means an oxygen that is double bonded to a carbon atom.

The term "alkylarylene" as an arylene moiety covalently bonded to an alkylene moiety (also referred to herein as an alkylene linker). In certain embodiments, the alkylarylene group has the formula:

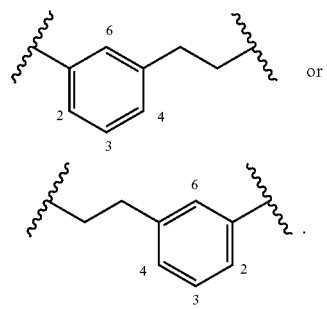

An alkylarylene moiety may be substituted (e.g. with a substituent group) on the alkylene moiety or the arylene linker (e.g. at carbons 2, 3, 4, or 6) with halogen, oxo, —N$_3$, —CF$_3$, —CCl$_3$, —CBr$_3$, —CI$_3$, —CN, —CHO, —OH, —NH$_2$, —COOH, —CONH$_2$, —NO$_2$, —SH, —SO$_2$CH$_3$ —SO$_3$H, —OSO$_3$H, —SO$_2$NH$_2$, —NHNH$_2$, —ONH$_2$, —NHC(O)NHNH$_2$, substituted or unsubstituted C$_1$-C$_5$ alkyl or substituted or unsubstituted 2 to 5 membered heteroalkyl). In certain embodiments, the alkylarylene is unsubstituted.

Each of the above terms (e.g., "alkyl," "heteroalkyl," "cycloalkyl," "heterocycloalkyl," "aryl," and "heteroaryl") includes both substituted and unsubstituted forms of the indicated radical. Preferred substituents for each type of radical are provided below.

Substituents for the alkyl and heteroalkyl radicals (including those groups often referred to as alkylene, alkenyl, heteroalkylene, heteroalkenyl, alkynyl, cycloalkyl, heterocycloalkyl, cycloalkenyl, and heterocycloalkenyl) can be one or more of a variety of groups selected from, but not limited to, —OR', =O, =NR', =N—OR', —NR'R", —SR', -halogen, —SiR'R"R'", —OC(O)R', —C(O)R', —CO$_2$R', —CONR'R", —OC(O)NR'R", —NR"C(O)R', —NR'—C(O)NR"R'", —NR"C(O)$_2$R', —NR—C(NR'R"R'")=NR"", —NR—C(NR'R")=NR'", —S(O)R', —S(O)$_2$R', —S(O)$_2$NR'R", —NRSO$_2$R', —NR'NR"R'", —ONR'R", —NR'C(O)NR"NR'"R"", —CN, —NO$_2$, —NR'SO$_2$R", —NR'C(O)R", —NR'C(O)—OR", —NR'OR", in a number ranging from zero to (2m'+1), where m' is the total number of carbon atoms in such radical. R, R', R", R'", and R"" each preferably independently refer to hydrogen, substituted or unsubstituted heteroalkyl, substituted or unsubstituted cycloalkyl, substituted or unsubstituted heterocycloalkyl, substituted or unsubstituted aryl (e.g., aryl substituted with 1-3 halogens), substituted or unsubstituted heteroaryl, substituted or unsubstituted alkyl, alkoxy, or thioalkoxy groups, or arylalkyl groups. When a compound described herein includes more than one R group, for example, each of the R groups is independently selected as are each R', R", R'", and R"" group when more than one of these groups is present. When R' and R" are attached to the same nitrogen atom, they can be combined with the nitrogen atom to form a 4-, 5-, 6-, or 7-membered ring. For example, —NR'R" includes, but is not limited to, 1-pyrrolidinyl and 4-morpholinyl. From the above discussion of substituents, one of skill in the art will understand that the term "alkyl" is meant to include groups including carbon atoms bound to groups other than hydrogen groups, such as haloalkyl (e.g., —CF$_3$ and —CH$_2$CF$_3$) and acyl (e.g., —C(O)CH$_3$, —C(O)CF$_3$, —C(O)CH$_2$OCH$_3$, and the like).

Similar to the substituents described for the alkyl radical, substituents for the aryl and heteroaryl groups are varied and are selected from, for example: —OR', —NR'R", —SR', -halogen, —SiR'R"R''', —OC(O)R', —C(O)R', —CO$_2$R', —CONR'R", —OC(O)NR'R", —NR"C(O)R', —NR'—C(O)NR"R''', —NR"C(O)$_2$R', —NR—C(NR'R"R''')=NR''', —NR—C(NR'R")=NR''', —S(O)R', —S(O)$_2$R', —S(O)$_2$NR'R", —NRSO$_2$R', —NR'NR"R''', —ONR'R", —NR'C(O)NR"NR'''R"", —CN, —NO$_2$, —R', —N$_3$, —CH(Ph)2, fluoro (C$_1$-C$_4$)alkoxy, and fluoro(C$_1$-C$_4$)alkyl, —NR'SO$_2$R", —NR'C(O)R", —NR'C(O)—OR", —NR'OR", in a number ranging from zero to the total number of open valences on the aromatic ring system; and where R', R", R''', and R"" are preferably independently selected from hydrogen, substituted or unsubstituted alkyl, substituted or unsubstituted heteroalkyl, substituted or unsubstituted cycloalkyl, substituted or unsubstituted heterocycloalkyl, substituted or unsubstituted aryl, and substituted or unsubstituted heteroaryl. When a compound described herein includes more than one R group, for example, each of the R groups is independently selected as are each R', R", R''', and R"" groups when more than one of these groups is present.

Substituents for rings (e.g. cycloalkyl, heterocycloalkyl, aryl, heteroaryl, cycloalkylene, heterocycloalkylene, arylene, or heteroarylene) may be depicted as substituents on the ring rather than on a specific atom of a ring (commonly referred to as a floating substituent). In such a case, the substituent may be attached to any of the ring atoms (obeying the rules of chemical valency) and in the case of fused rings or spirocyclic rings, a substituent depicted as associated with one member of the fused rings or spirocyclic rings (a floating substituent on a single ring), may be a substituent on any of the fused rings or spirocyclic rings (a floating substituent on multiple rings). When a substituent is attached to a ring, but not a specific atom (a floating substituent), and a subscript for the substituent is an integer greater than one, the multiple substituents may be on the same atom, same ring, different atoms, different fused rings, different spirocyclic rings, and each substituent may optionally be different. Where a point of attachment of a ring to the remainder of a molecule is not limited to a single atom (a floating substituent), the attachment point may be any atom of the ring and in the case of a fused ring or spirocyclic ring, any atom of any of the fused rings or spirocyclic rings while obeying the rules of chemical valency. Where a ring, fused rings, or spirocyclic rings contain one or more ring heteroatoms and the ring, fused rings, or spirocyclic rings are shown with one more floating substituents (including, but not limited to, points of attachment to the remainder of the molecule), the floating substituents may be bonded to the heteroatoms. Where the ring heteroatoms are shown bound to one or more hydrogens (e.g. a ring nitrogen with two bonds to ring atoms and a third bond to a hydrogen) in the structure or formula with the floating substituent, when the heteroatom is bonded to the floating substituent, the substituent will be understood to replace the hydrogen, while obeying the rules of chemical valency.

Two or more substituents may optionally be joined to form aryl, heteroaryl, cycloalkyl, or heterocycloalkyl groups. Such so-called ring-forming substituents are typically, though not necessarily, found attached to a cyclic base structure. In one embodiment, the ring-forming substituents are attached to adjacent members of the base structure. For example, two ring-forming substituents attached to adjacent members of a cyclic base structure create a fused ring structure. In another embodiment, the ring-forming substituents are attached to a single member of the base structure. For example, two ring-forming substituents attached to a single member of a cyclic base structure create a spirocyclic structure. In yet another embodiment, the ring-forming substituents are attached to non-adjacent members of the base structure.

Two of the substituents on adjacent atoms of the aryl or heteroaryl ring may optionally form a ring of the formula —T—C(O)—(CRR')$_q$—U—, wherein T and U are independently —NR—, —O—, —CRR'—, or a single bond, and q is an integer of from 0 to 3. Alternatively, two of the substituents on adjacent atoms of the aryl or heteroaryl ring may optionally be replaced with a substituent of the formula —A—(CH$_2$)$_r$—B—, wherein A and B are independently —CRR'—, —O—, —NR—, —S—, —S(O)—, —S(O)$_2$—, —S(O)$_2$NR'—, or a single bond, and r is an integer of from 1 to 4. One of the single bonds of the new ring so formed may optionally be replaced with a double bond. Alternatively, two of the substituents on adjacent atoms of the aryl or heteroaryl ring may optionally be replaced with a substituent of the formula —(CRR')$_s$—X'—(C"R"R''')$_d$—, where s and d are independently integers of from 0 to 3, and X' is —O—, —NR'—, —S—, —S(O)—, —S(O)$_2$—, or —S(O)$_2$NR'—. The substituents R, R', R", and R''' are preferably independently selected from hydrogen, substituted or unsubstituted alkyl, substituted or unsubstituted heteroalkyl, substituted or unsubstituted cycloalkyl, substituted or unsubstituted heterocycloalkyl, substituted or unsubstituted aryl, and substituted or unsubstituted heteroaryl.

As used herein, the terms "heteroatom" or "ring heteroatom" are meant to include oxygen (O), nitrogen (N), sulfur (S), phosphorus (P), and silicon (Si).

A "substituent group," as used herein, means a group selected from the following moieties:

(A) oxo, halogen, —CF$_3$, —CN, —OH, —NH$_2$, —COOH, —CONH$_2$, —NO$_2$, —SH, —SO$_3$H, —SO$_4$H, —SO$_2$NH$_2$, —NHNH$_2$, —ONH$_2$, —NHC=(O)NHNH$_2$, —NHC=(O) NH$_2$, —NHSO$_2$H, —NHC=(O)H, —NHC(O)—OH, —NHOH, —OCF$_3$, —OCHF$_2$, unsubstituted alkyl, unsubstituted heteroalkyl, unsubstituted cycloalkyl, unsubstituted heterocycloalkyl, unsubstituted aryl, unsubstituted heteroaryl, and (B) alkyl, heteroalkyl, cycloalkyl, heterocycloalkyl, aryl, heteroaryl, substituted with at least one substituent selected from:

(i) oxo, halogen, —CF$_3$, —CN, —OH, —NH$_2$, —COOH, —CONH$_2$, —NO$_2$, —SH, —SO$_3$H, —SO$_4$H, —SO$_2$NH$_2$, —NHNH$_2$, —ONH$_2$, —NHC=(O)NHNH$_2$, —NHC=(O) NH$_2$, —NHSO$_2$H, —NHC=(O)H, —NHC(O)—OH, —NHOH, —OCF$_3$, —OCHF$_2$, unsubstituted alkyl, unsubstituted heteroalkyl, unsubstituted cycloalkyl, unsubstituted heterocycloalkyl, unsubstituted aryl, unsubstituted heteroaryl, and (ii) alkyl, heteroalkyl, cycloalkyl, heterocycloalkyl, aryl, heteroaryl, substituted with at least one substituent selected from:

(a) oxo, halogen, —CF$_3$, —CN, —OH, —NH$_2$, —COOH, —CONH$_2$, —NO$_2$, —SH, —SO$_3$H, —SO$_4$H, —SO$_2$NH$_2$, —NHNH$_2$, —ONH$_2$, —NHC=(O)NHNH$_2$, —NHC=(O) NH$_2$, —NHSO$_2$H, —NHC=(O)H, —NHC(O)—OH, —NHOH, —OCF$_3$, —OCHF$_2$, unsubstituted alkyl, unsubstituted heteroalkyl, unsubstituted cycloalkyl, unsubstituted heterocycloalkyl, unsubstituted aryl, unsubstituted heteroaryl, and (b) alkyl, heteroalkyl, cycloalkyl, heterocycloalkyl, aryl, heteroaryl, substituted with at least one substituent selected from: oxo, halogen, —CF$_3$, —CN, —OH, —NH$_2$, —COOH, —CONH$_2$, —NO$_2$, —SH, —SO$_3$H, —SO$_4$H, —SO$_2$NH$_2$, —NHNH$_2$, —ONH$_2$, —NHC═(O)NHNH$_2$, —NHC═(O) NH$_2$, —NHSO$_2$H, —NHC═(O)H, —NHC(O)—OH, —NHOH, —OCF$_3$, —OCHF$_2$, unsubstituted alkyl, unsubstituted heteroalkyl, unsubstituted cycloalkyl, unsubstituted heterocycloalkyl, unsubstituted aryl, unsubstituted heteroaryl.

A "size-limited substituent" or "size-limited substituent group," as used herein, means a group selected from all of the substituents described above for a "substituent group," wherein each substituted or unsubstituted alkyl is a substituted or unsubstituted C$_1$-C$_{20}$ alkyl, each substituted or unsubstituted heteroalkyl is a substituted or unsubstituted 2 to 20 membered heteroalkyl, each substituted or unsubstituted cycloalkyl is a substituted or unsubstituted C$_3$-C$_8$ cycloalkyl, each substituted or unsubstituted heterocycloalkyl is a substituted or unsubstituted 3 to 8 membered heterocycloalkyl, each substituted or unsubstituted aryl is a substituted or unsubstituted C$_6$-C$_{10}$ aryl, and each substituted or unsubstituted heteroaryl is a substituted or unsubstituted 5 to 10 membered heteroaryl.

A "lower substituent" or "lower substituent group," as used herein, means a group selected from all of the substituents described above for a "substituent group," wherein each substituted or unsubstituted alkyl is a substituted or unsubstituted C$_1$-C$_8$ alkyl, each substituted or unsubstituted heteroalkyl is a substituted or unsubstituted 2 to 8 membered heteroalkyl, each substituted or unsubstituted cycloalkyl is a substituted or unsubstituted C$_3$-C$_7$ cycloalkyl, each substituted or unsubstituted heterocycloalkyl is a substituted or unsubstituted 3 to 7 membered heterocycloalkyl, each substituted or unsubstituted aryl is a substituted or unsubstituted C$_6$-C$_{10}$ aryl, and each substituted or unsubstituted heteroaryl is a substituted or unsubstituted 5 to 9 membered heteroaryl.

In some certain embodiments, each substituted group described in the compounds herein is substituted with at least one substituent group. More specifically, in some certain embodiments, each substituted alkyl, substituted heteroalkyl, substituted cycloalkyl, substituted heterocycloalkyl, substituted aryl, substituted heteroaryl, substituted alkylene, substituted heteroalkylene, substituted cycloalkylene, substituted heterocycloalkylene, substituted arylene, and/or substituted heteroarylene described in the compounds herein are substituted with at least one substituent group. In other certain embodiments, at least one or all of these groups are substituted with at least one size-limited substituent group. In other certain embodiments, at least one or all of these groups are substituted with at least one lower substituent group.

In other embodiments of the compounds herein, each substituted or unsubstituted alkyl may be a substituted or unsubstituted C$_1$-C$_{20}$ alkyl, each substituted or unsubstituted heteroalkyl is a substituted or unsubstituted 2 to 20 membered heteroalkyl, each substituted or unsubstituted cycloalkyl is a substituted or unsubstituted C$_3$-C$_8$ cycloalkyl, each substituted or unsubstituted heterocycloalkyl is a substituted or unsubstituted 3 to 8 membered heterocycloalkyl, each substituted or unsubstituted aryl is a substituted or unsubstituted C$_6$-C$_{10}$ aryl, and/or each substituted or unsubstituted heteroaryl is a substituted or unsubstituted 5 to 10 membered heteroaryl. In some embodiments of the compounds herein, each substituted or unsubstituted alkylene is a substituted or unsubstituted C$_1$-C$_{20}$ alkylene, each substituted or unsubstituted heteroalkylene is a substituted or unsubstituted 2 to 20 membered heteroalkylene, each substituted or unsubstituted cycloalkylene is a substituted or unsubstituted C$_3$-C$_8$ cycloalkylene, each substituted or unsubstituted heterocycloalkylene is a substituted or unsubstituted 3 to 8 membered heterocycloalkylene, each substituted or unsubstituted arylene is a substituted or unsubstituted C$_6$-C$_{10}$ arylene, and/or each substituted or unsubstituted heteroarylene is a substituted or unsubstituted 5 to 10 membered heteroarylene.

In some certain embodiments, each substituted or unsubstituted alkyl is a substituted or unsubstituted C$_1$-C$_8$ alkyl, each substituted or unsubstituted heteroalkyl is a substituted or unsubstituted 2 to 8 membered heteroalkyl, each substituted or unsubstituted cycloalkyl is a substituted or unsubstituted C$_3$-C$_7$ cycloalkyl, each substituted or unsubstituted heterocycloalkyl is a substituted or unsubstituted 3 to 7 membered heterocycloalkyl, each substituted or unsubstituted aryl is a substituted or unsubstituted C$_6$-C$_{10}$ aryl, and/or each substituted or unsubstituted heteroaryl is a substituted or unsubstituted 5 to 9 membered heteroaryl. In some certain embodiments, each substituted or unsubstituted alkylene is a substituted or unsubstituted C$_1$-C$_8$ alkylene, each substituted or unsubstituted heteroalkylene is a substituted or unsubstituted 2 to 8 membered heteroalkylene, each substituted or unsubstituted cycloalkylene is a substituted or unsubstituted C$_3$-C$_7$ cycloalkylene, each substituted or unsubstituted heterocycloalkylene is a substituted or unsubstituted 3 to 7 membered heterocycloalkylene, each substituted or unsubstituted arylene is a substituted or unsubstituted C$_6$-C$_{10}$ arylene, and/or each substituted or unsubstituted heteroarylene is a substituted or unsubstituted 5 to 9 membered heteroarylene. In some certain embodiments, the compound is a chemical species set forth in the Examples section, figures, or tables below.

Certain compounds of the present invention possess asymmetric carbon atoms (optical or chiral centers) or double bonds; the enantiomers, racemates, diastereomers, tautomers, geometric isomers, stereoisometric forms that may be defined, in terms of absolute stereochemistry, as (R)- or (S)- or, as (D)- or (L)- for amino acids, and individual isomers are encompassed within the scope of the present invention. The compounds of the present invention do not include those that are known in art to be too unstable to synthesize and/or isolate. The present invention is meant to include compounds in racemic and optically pure forms. Optically active (R)- and (S)-, or (D)- and (L)-isomers may be prepared using chiral synthons or chiral reagents, or resolved using conventional techniques. When the compounds described herein contain olefinic bonds or other centers of geometric asymmetry, and unless specified otherwise, it is intended that the compounds include both E and Z geometric isomers.

As used herein, the term "isomers" refers to compounds having the same number and kind of atoms, and hence the same molecular weight, but differing in respect to the structural arrangement or configuration of the atoms.

The term "tautomer," as used herein, refers to one of two or more structural isomers which exist in equilibrium and which are readily converted from one isomeric form to another.

It will be apparent to one skilled in the art that certain compounds of this invention may exist in tautomeric forms, all such tautomeric forms of the compounds being within the scope of the invention.

Unless otherwise stated, structures depicted herein are also meant to include all stereochemical forms of the structure; i.e., the R and S configurations for each asymmetric center. Therefore, single stereochemical isomers as well as enantiomeric and diastereomeric mixtures of the present compounds are within the scope of the invention.

Unless otherwise stated, structures depicted herein are also meant to include compounds which differ only in the presence of one or more isotopically enriched atoms. For example, compounds having the present structures except for the replacement of a hydrogen by a deuterium or tritium, or the replacement of a carbon by $^{13}$C- or $^{14}$C-enriched carbon are within the scope of this invention.

The compounds of the present invention may also contain unnatural proportions of atomic isotopes at one or more of the atoms that constitute such compounds. For example, the compounds may be radiolabeled with radioactive isotopes, such as for example tritium ($^{3}$H), iodine-125 ($^{125}$I), or carbon-14 ($^{14}$C). All isotopic variations of the compounds of the present invention, whether radioactive or not, are encompassed within the scope of the present invention.

It should be noted that throughout the application that alternatives are written in Markush groups, for example, each amino acid position that contains more than one possible amino acid. It is specifically contemplated that each member of the Markush group should be considered separately, thereby comprising another embodiment, and the Markush group is not to be read as a single unit.

"Analog" or "analogue" is used in accordance with its plain ordinary meaning within Chemistry and Biology and refers to a chemical compound that is structurally similar to another compound (i.e., a so-called "reference" compound) but differs in composition, e.g., in the replacement of one atom by an atom of a different element, or in the presence of a particular functional group, or the replacement of one functional group by another functional group, or the absolute stereochemistry of one or more chiral centers of the reference compound. Accordingly, an analog is a compound that is similar or comparable in function and appearance but not in structure or origin to a reference compound.

The terms "a" or "an," as used in herein means one or more. In addition, the phrase "substituted with a[n]," as used herein, means the specified group may be substituted with one or more of any or all of the named substituents. For example, where a group, such as an alkyl or heteroaryl group, is "substituted with an unsubstituted $C_1$-$C_{20}$ alkyl, or unsubstituted 2 to 20 membered heteroalkyl," the group may contain one or more unsubstituted $C_1$-$C_{20}$ alkyls, and/or one or more unsubstituted 2 to 20 membered heteroalkyls.

Moreover, where a moiety is substituted with an R substituent, the group may be referred to as "R-substituted." Where a moiety is R-substituted, the moiety is substituted with at least one R substituent and each R substituent is optionally different. Where a particular R group is present in the description of a chemical genus (such as Formula (II)), a Roman alphabetic symbol may be used to distinguish each appearance of that particular R group. For example, where multiple $R^3$ substituents are present, each $R^3$ substituent may be distinguished as $R^{13A}$, $R^{13B}$, $R^{13C}$, $R^{13D}$, etc., wherein each of $R^{13A}$, $R^{13B}$, $R^{13C}$, $R^{13D}$, etc. is defined within the scope of the definition of $R^{13}$ and optionally differently.

Descriptions of compounds of the present invention are limited by principles of chemical bonding known to those skilled in the art. Accordingly, where a group may be substituted by one or more of a number of substituents, such substitutions are selected so as to comply with principles of chemical bonding and to give compounds which are not inherently unstable and/or would be known to one of ordinary skill in the art as likely to be unstable under ambient conditions, such as aqueous, neutral, and several known physiological conditions. For example, a heterocycloalkyl or heteroaryl is attached to the remainder of the molecule via a ring heteroatom in compliance with principles of chemical bonding known to those skilled in the art thereby avoiding inherently unstable compounds.

The term "pharmaceutically acceptable salts" is meant to include salts of the active compounds that are prepared with relatively nontoxic acids or bases, depending on the particular substituents found on the compounds described herein. When compounds of the present invention contain relatively acidic functionalities, base addition salts can be obtained by contacting the neutral form of such compounds with a sufficient amount of the desired base, either neat or in a suitable inert solvent. Examples of pharmaceutically acceptable base addition salts include sodium, potassium, calcium, ammonium, organic amino, or magnesium salt, or a similar salt. When compounds of the present invention contain relatively basic functionalities, acid addition salts can be obtained by contacting the neutral form of such compounds with a sufficient amount of the desired acid, either neat or in a suitable inert solvent. Examples of pharmaceutically acceptable acid addition salts include those derived from inorganic acids like hydrochloric, hydrobromic, nitric, carbonic, monohydrogencarbonic, phosphoric, monohydrogenphosphoric, dihydrogenphosphoric, sulfuric, monohydrogensulfuric, hydriodic, or phosphorous acids and the like, as well as the salts derived from relatively nontoxic organic acids like acetic, propionic, isobutyric, maleic, malonic, benzoic, succinic, suberic, fumaric, lactic, mandelic, phthalic, benzenesulfonic, p-tolylsulfonic, citric, tartaric, oxalic, methanesulfonic, and the like. Also included are salts of amino acids such as arginate and the like, and salts of organic acids like glucuronic or galactunoric acids and the like (see, for example, Berge et al., "Pharmaceutical Salts", *Journal of Pharmaceutical Science,* 1977, 66, 1-19). Certain specific compounds of the present invention contain both basic and acidic functionalities that allow the compounds to be converted into either base or acid addition salts.

Thus, the compounds of the present invention may exist as salts, such as with pharmaceutically acceptable acids. The present invention includes such salts. Non-limiting examples of such salts include hydrochlorides, hydrobromides, phosphates, sulfates, methanesulfonates, nitrates, maleates, acetates, citrates, fumarates, proprionates, tartrates (e.g., (+)-tartrates, (−)-tartrates, or mixtures thereof including racemic mixtures), succinates, benzoates, and salts with amino acids such as glutamic acid, and quaternary ammonium salts (e.g. methyl iodide, ethyl iodide, and the like). These salts may be prepared by methods known to those skilled in the art.

The neutral forms of the compounds are preferably regenerated by contacting the salt with a base or acid and isolating the parent compound in the conventional manner. The parent form of the compound may differ from the various salt forms in certain physical properties, such as solubility in polar solvents. In certain embodiments, compounds of the present invention contain both basic and acidic functionalities that allow the compounds to be converted into either base or acid addition salts. The neutral forms of the compounds may be regenerated by contacting the salt with a base or acid and isolating the parent compound in a conventional manner. The parent form of the compounds differs from the various salt forms in certain physical properties, such as solubility in polar solvents, but, unless specifically indicated, the salts disclosed herein are equivalent to the parent form of the compound for the purposes of the present invention.

In addition to salt forms, the present invention provides compounds, which are in a prodrug form. Prodrugs of the compounds described herein are those compounds that readily undergo chemical changes under physiological conditions to provide the compounds of the present invention. Prodrugs of the compounds described herein may be converted in vivo after administration. Additionally, prodrugs can be converted to the compounds of the present invention by chemical or biochemical methods in an ex vivo environment, such as, for example, when contacted with a suitable enzyme or chemical reagent.

Certain compounds of the present invention can exist in unsolvated forms as well as solvated forms, including hydrated forms. In general, the solvated forms are equivalent to unsolvated forms and are encompassed within the scope of the present invention. Certain compounds of the present invention may exist in multiple crystalline or amorphous forms. In general, all physical forms are equivalent for the uses contemplated by the present invention and are intended to be within the scope of the present invention.

"Contacting" is used in accordance with its plain ordinary meaning and refers to the process of allowing at least two distinct species (e.g. chemical compounds including biomolecules or cells) to become sufficiently proximal to react, interact or physically touch. It should be appreciated; however, the resulting reaction product can be produced directly from a reaction between the added reagents or from an intermediate from one or more of the added reagents that can be produced in the reaction mixture.

The term "contacting" may include allowing two species to react, interact, or physically touch, wherein the two species may be a compound as described herein and a protein or enzyme. In some embodiments contacting includes allowing a compound described herein to interact with a protein or enzyme that is involved in a signaling pathway.

As defined herein, the term "activation", "activate", "activating" and the like in reference to a protein refers to conversion of a protein into a biologically active derivative from an initial inactive or deactivated state. The terms reference activation, or activating, sensitizing, or up-regulating signal transduction or enzymatic activity or the amount of a protein decreased in a disease.

The terms "agonist," "activator," "upregulator," etc. refer to a substance capable of detectably increasing the expression or activity of a given gene or protein. The agonist can increase expression or activity 10%, 20%, 30%, 40%, 50%, 60%, 70%, 80%, 90% or more in comparison to a control in the absence of the agonist. In certain instances, expression or activity is 1.5-fold, 2-fold, 3-fold, 4-fold, 5-fold, 10-fold or higher than the expression or activity in the absence of the agonist. In certain embodiments, an agonist is a molecule that interacts with a target to cause or promote an increase in the activation of the target. In certain embodiments, activators are molecules that increase, activate, facilitate, enhance activation, sensitize, or up-regulate, e.g., a gene, protein, ligand, receptor, or cell.

As defined herein, the term "inhibition," "inhibit," "inhibiting," and the like, in reference to a protein-inhibitor interaction means negatively affecting (e.g. decreasing) the activity or function of the protein relative to the activity or function of the protein in the absence of the inhibitor. In embodiments inhibition means negatively affecting (e.g. decreasing) the concentration or levels of the protein relative to the concentration or level of the protein in the absence of the inhibitor. In embodiments inhibition refers to reduction of a disease or symptoms of disease. In certain embodiments, inhibition refers to a reduction in the activity of a particular protein target. Thus, inhibition includes, at least in part, partially or totally blocking stimulation, decreasing, preventing, or delaying activation, or inactivating, desensitizing, or down-regulating signal transduction or enzymatic activity or the amount of a protein. In certain embodiments, inhibition refers to a reduction of activity of a target protein resulting from a direct interaction (e.g. an inhibitor binds to the target protein). In certain embodiments, inhibition refers to a reduction of activity of a target protein from an indirect interaction (e.g. an inhibitor binds to a protein that activates the target protein, thereby preventing target protein activation).

The terms "inhibitor," "repressor" or "antagonist" or "downregulator" interchangeably refer to a substance capable of detectably decreasing the expression or activity of a given gene or protein. The antagonist can decrease expression or activity 10%, 20%, 30%, 40%, 50%, 60%, 70%, 80%, 90% or more in comparison to a control in the absence of the antagonist. In certain instances, expression or activity is 1.5-fold, 2-fold, 3-fold, 4-fold, 5-fold, 10-fold or lower than the expression or activity in the absence of the antagonist. An antagonist prevents, reduces, inhibits, or neutralizes the activity of an agonist, and an antagonist can also prevent, inhibit, or reduce constitutive activity of a target, e.g., a target receptor, even where there is no identified agonist. In certain embodiments, inhibitors are molecules that decrease, block, prevent, delay activation, inactivate, desensitize, or down-regulate, e.g., a gene, protein, ligand, receptor, or cell. An inhibitor may also be defined as a molecule that reduces, blocks, or inactivates a constitutive activity. An "antagonist" is a molecule that opposes the action(s) of an agonist.

The terms "disease" or "condition" refer to a state of being or health status of a patient or subject capable of being treated with the compounds or methods provided herein. The disease may be a cancer.

The terms "treating" or "treatment" refer to any indicia of success in the therapy or amelioration of an injury, disease, pathology or condition, including any objective or subjective parameter such as abatement; remission; diminishing of symptoms or making the injury, pathology or condition more tolerable to the patient; slowing in the rate of degeneration or decline; making the final point of degeneration less debilitating; improving a patient's physical or mental well-being. The treatment or amelioration of symptoms can be based on objective or subjective parameters; including the results of a physical examination, neuropsychiatric exams, and/or a psychiatric evaluation. The term "treating" and conjugations thereof, may include prevention of an injury, pathology, condition, or disease. In certain embodiments, treating is preventing. In certain embodiments, treating does not include preventing.

"Treating" or "treatment" as used herein (and as well-understood in the art) also broadly includes any approach for obtaining beneficial or desired results in a subject's condition, including clinical results. Beneficial or desired clinical results can include, but are not limited to, alleviation or amelioration of one or more symptoms or conditions, diminishment of the extent of a disease, stabilizing (i.e., not worsening) the state of disease, prevention of a disease's transmission or spread, delay or slowing of disease progression, amelioration or palliation of the disease state, diminishment of the reoccurrence of disease, and remission, whether partial or total and whether detectable or undetectable. In other words, "treatment" as used herein includes any cure, amelioration, or prevention of a disease. Treatment may prevent the disease from occurring; inhibit the disease's spread; relieve the disease's symptoms, fully or partially remove the disease's underlying cause, shorten a disease's duration, or do a combination of these things.

"Treating" and "treatment" as used herein include prophylactic treatment. Treatment methods include administering to a subject a therapeutically effective amount of a compound described herein. The administering step may consist of a single administration or may include a series of administrations. The length of the treatment period depends on a variety of factors, such as the severity of the condition, the age of the patient, the concentration of the compound, the activity of the compositions used in the treatment, or a combination thereof. It will also be appreciated that the effective dosage of an agent used for the treatment or prophylaxis may increase or decrease over the course of a particular treatment or prophylaxis regime. Changes in dosage may result and become apparent by standard diagnostic assays known in the art. In some instances, chronic administration may be required. For example, the compositions are administered to the subject in an amount and for a duration sufficient to treat the patient.

The term "prevent" refers to a decrease in the occurrence of disease symptoms in a patient. As indicated above, the prevention may be complete (no detectable symptoms) or partial, such that fewer symptoms are observed than would likely occur absent treatment. In certain embodiments, prevent refers to slowing the progression of the disease, disorder or condition or inhibiting progression thereof to a harmful or otherwise undesired state.

Examples

These examples are provided for illustrative purposes only and not to limit the scope of the claims provided herein.

Chemical Synthesis Examples

The compounds in Tables 1-3 are prepared in the following examples.

TABLE 1

| Compound/Eg No | UNA Structure | UNA Structure as a part of oligonucleotide |
|---|---|---|
| 1 | [chemical structure with ODMT, phosphoramidite, uracil base, and methoxyethyl group] | 5' End of nucleotide [chemical structure with X=P-OH linkages, X = O or S, uracil base] 3' end of nucleotide |
| 2 | [chemical structure with ODMT, phosphoramidite, NHBz-cytosine base, and methoxyethyl group] | [chemical structure with phosphoramidite, NHBz-cytosine base, and methoxyethyl group] |

TABLE 1-continued
| Compound/ Eg No | UNA Structure | UNA Structure as a part of oligonucleotide |
|---|---|---|
| 3 | 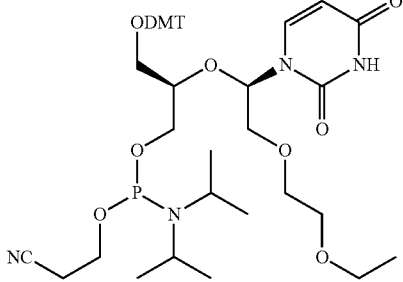 | 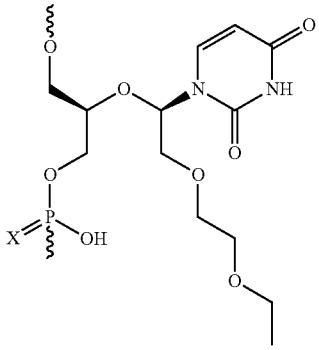 |
| 4 | 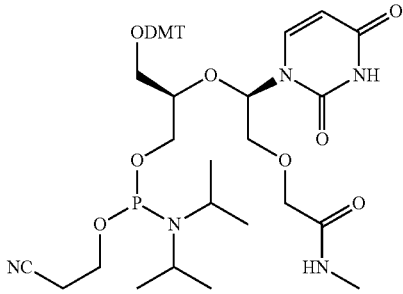 | 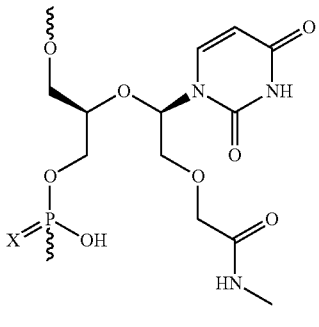 |
| 5 | 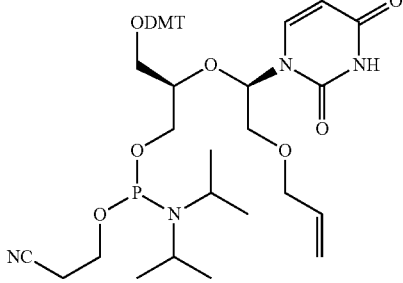 | 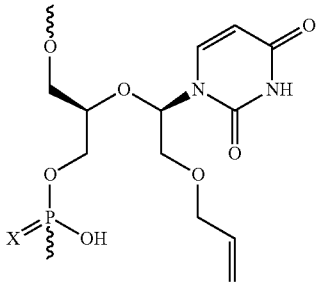 |
| 6 | 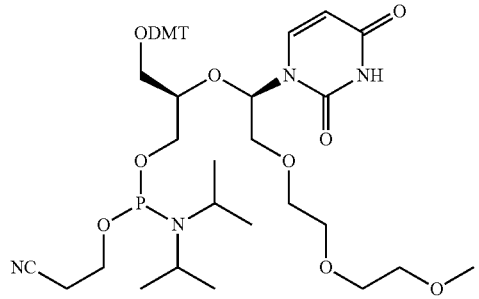 | 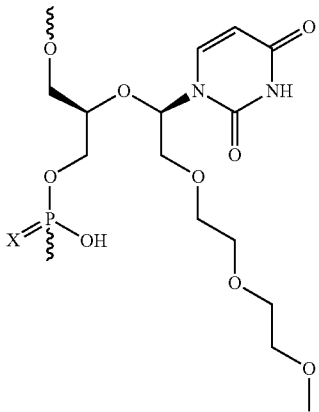 |

TABLE 1-continued
| Compound/Eg No | UNA Structure | UNA Structure as a part of oligonucleotide |
|---|---|---|
| 7 | 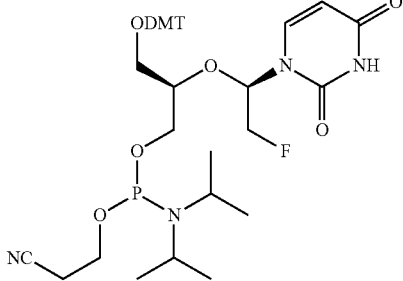 | 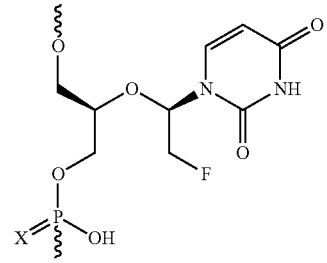 |
| 8 | 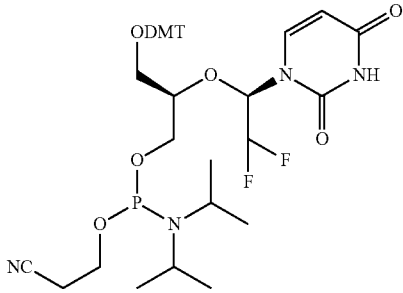 | 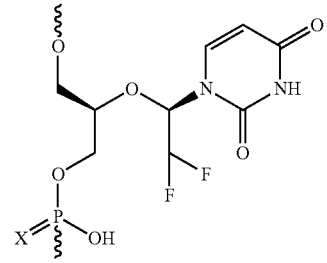 |
| 9 | 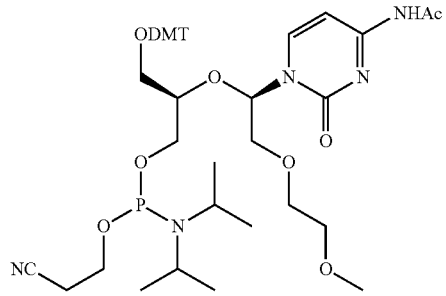 | 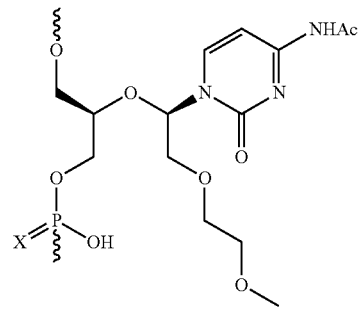 |
| 10 | 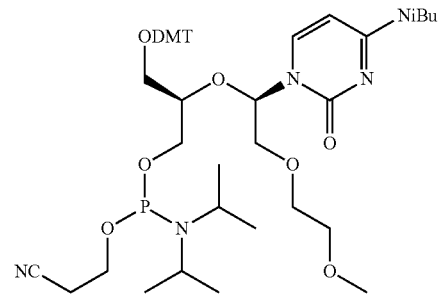 | 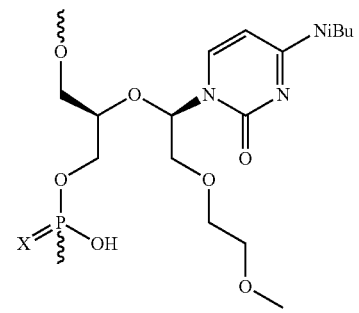 |
| 11 | 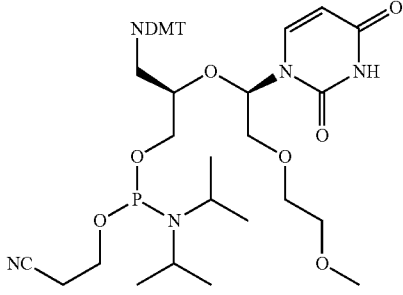 | 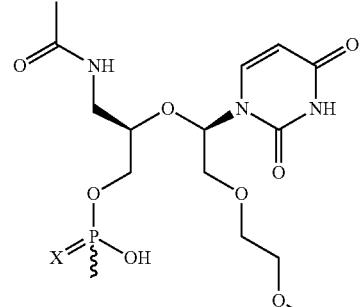 |

TABLE 1-continued
| Compound/ Eg No | UNA Structure | UNA Structure as a part of oligonucleotide |
|---|---|---|
| 12 | 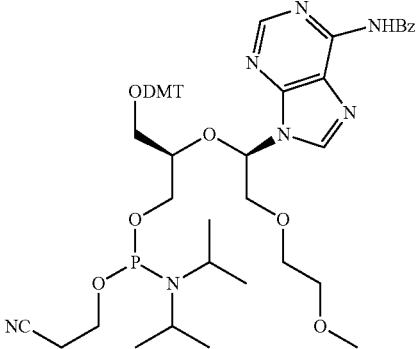 | 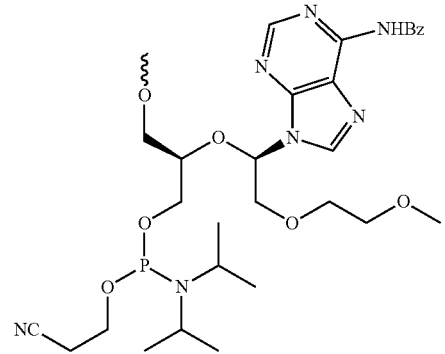 |
| 13 | 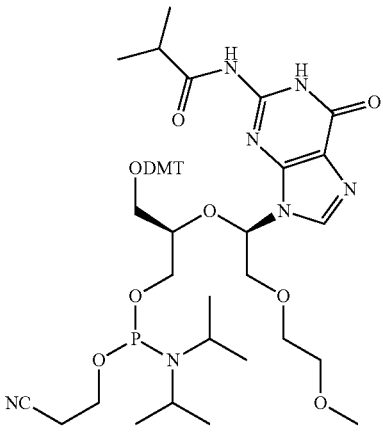 | 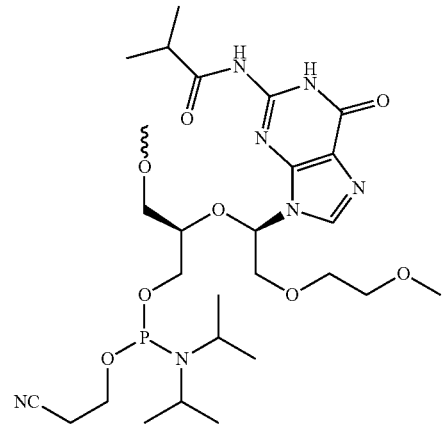 |
| 14 | 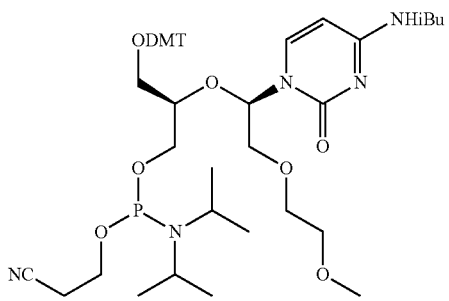 | 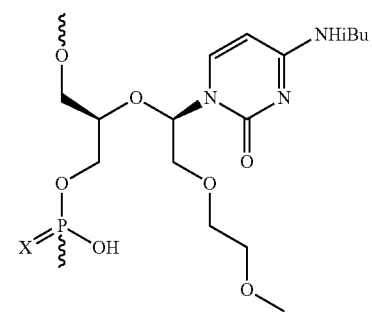 |

TABLE 2
| Compound/Eg No | Structure | UNA Structure as a part of oligonucleotide |
|---|---|---|
| 15 | 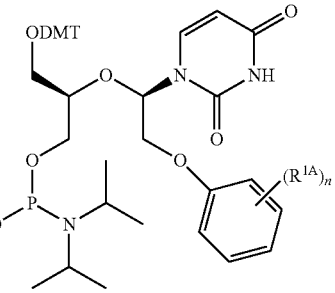 | 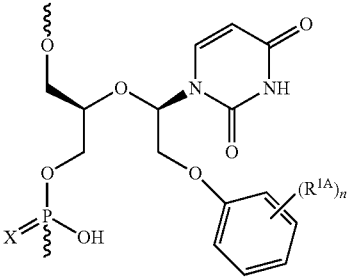 |
TABLE 3
| Compound/Eg No | Structure | UNA Structure as a part of oligonucleotide |
|---|---|---|
| 16 | 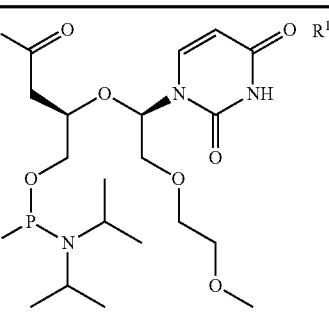 | 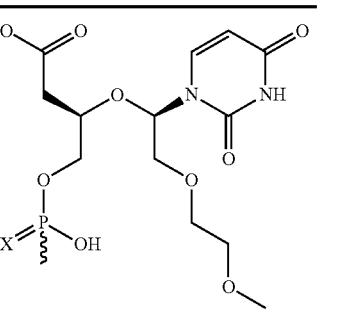<br>5' End carboxyl |
Example 1. General Synthetic Scheme for the Preparation of Compounds 1-13. UNA 2' Derivatives
Compounds 1-15 are synthesized according to the following schemes.
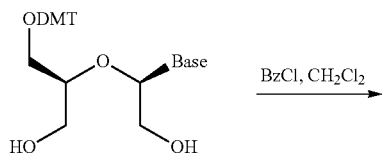
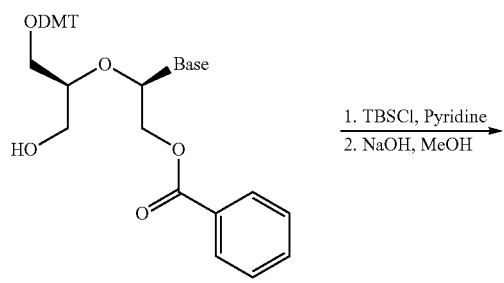
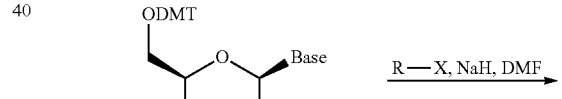
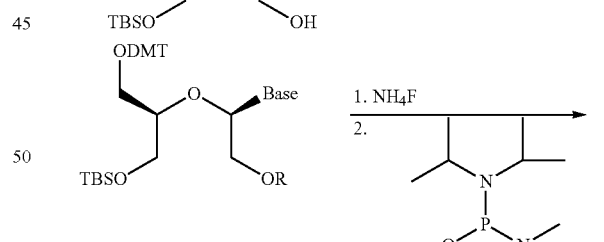
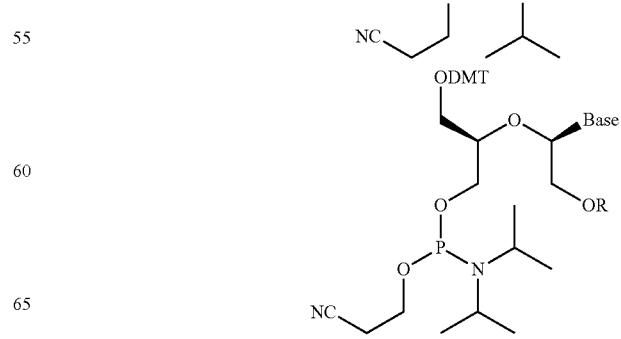

Base =
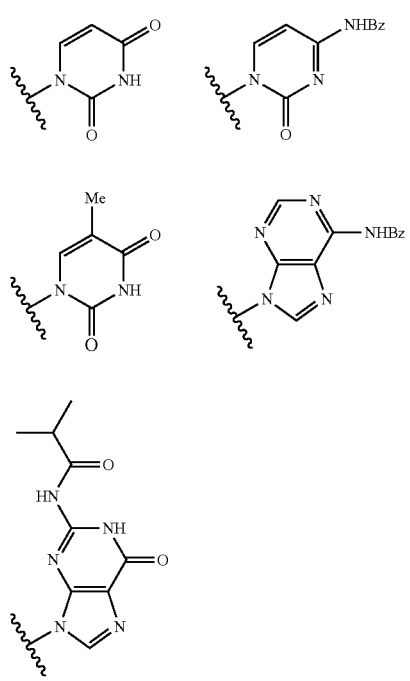
R—X =
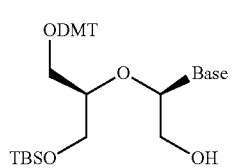
Example 2. General Synthetic Scheme for UNA 2' Fluoro Compounds
Compounds 2 and 8 are synthesized according to the following schemes.
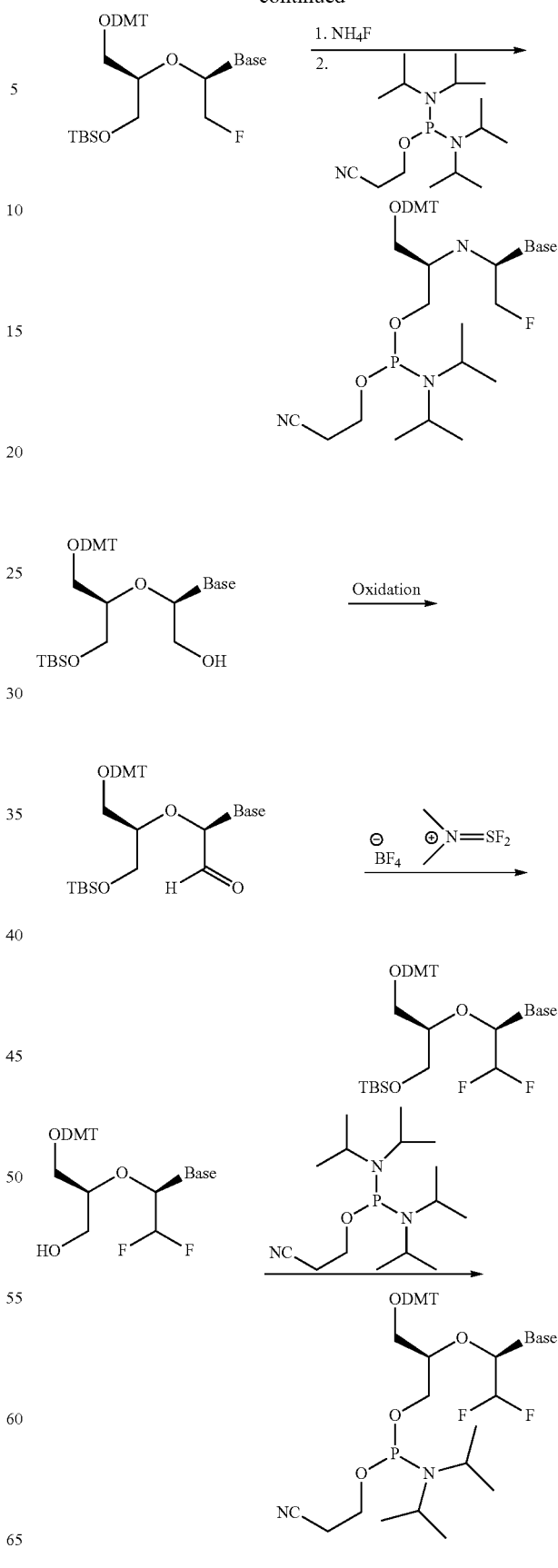

Example 3. General Synthetic Scheme for the Solid
Phase Synthesis of Oligonucleotides
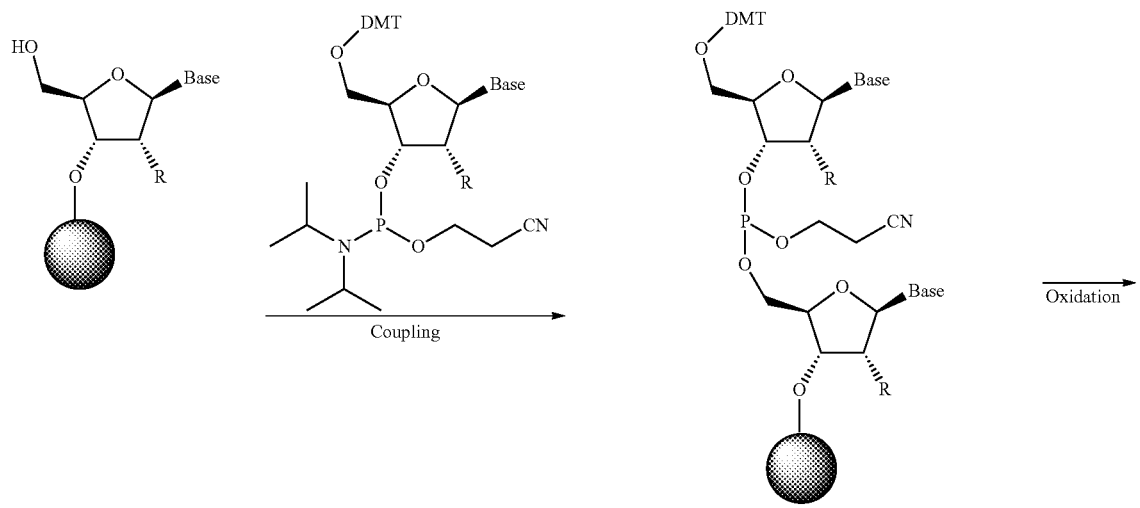
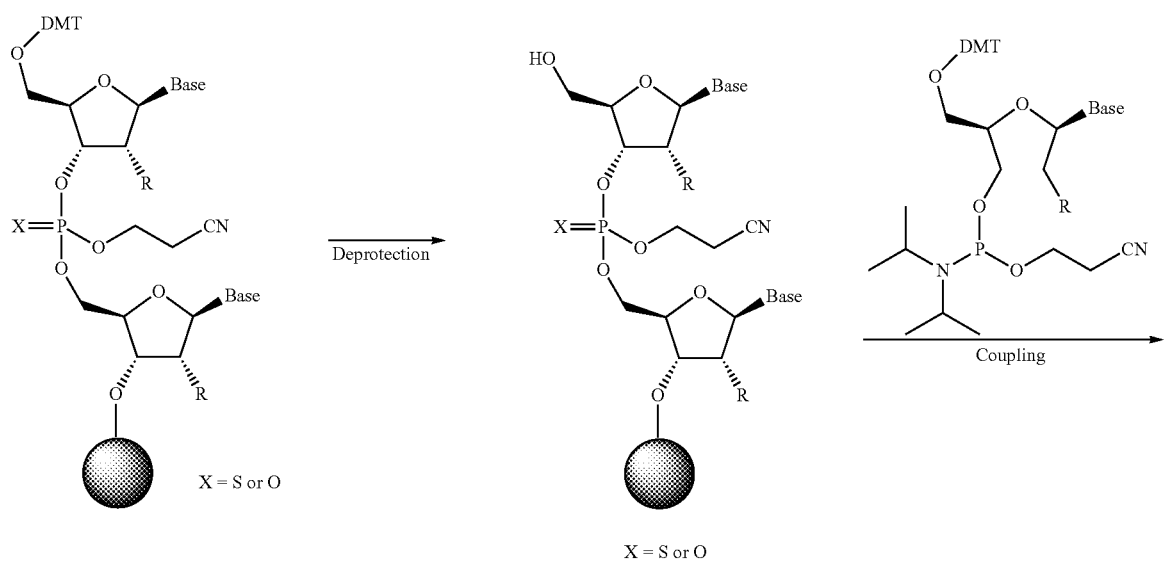

109
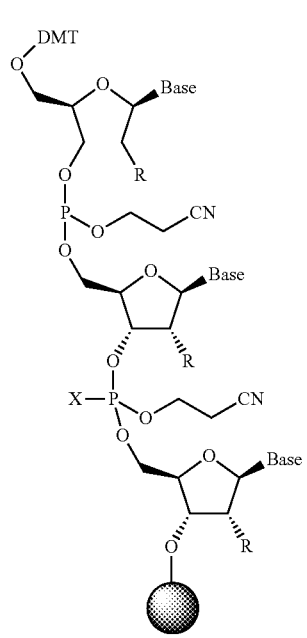
-continued
110
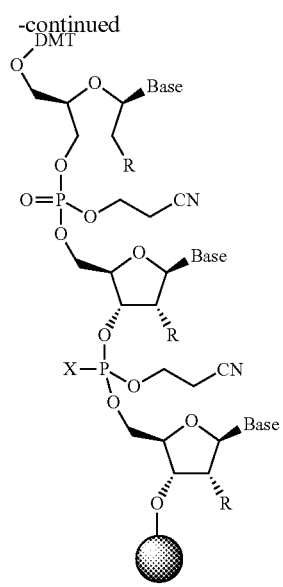
Oxidation →
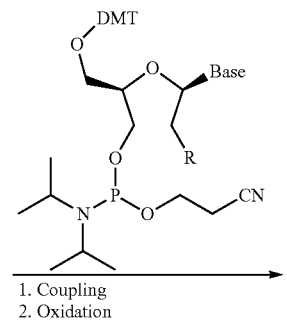
1. Coupling
2. Oxidation
→
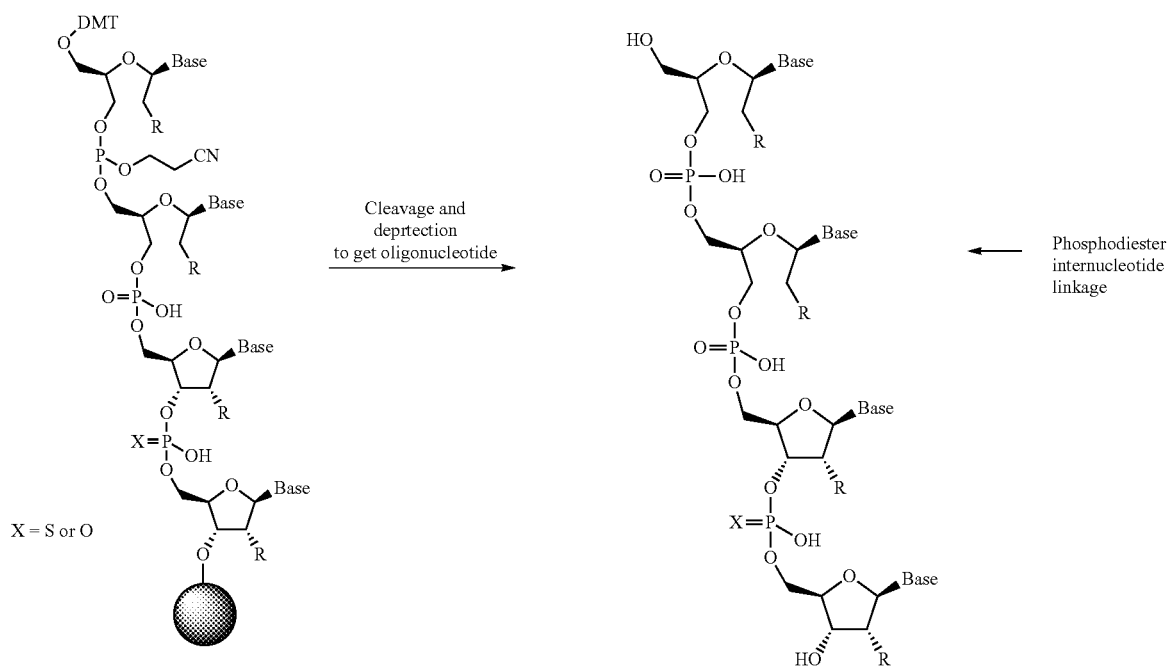
X = S or O
Cleavage and deprtection to get oligonucleotide →
← Phosphodiester internucleotide linkage
↓
Oligonucleotide could be further lengthened by repeating additonal cycles of coupling and oxidation

Example 4. UNA Key

TABLE 4

| Structure | Modification Name | Code |
|---|---|---|
| 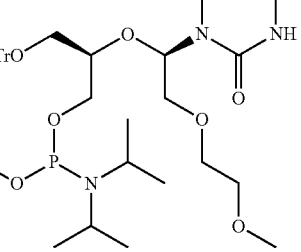 | UNA with 2'-MOE | Uq |
| 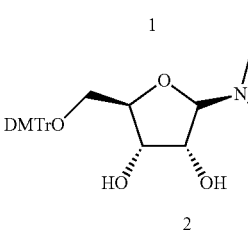 | UNA with 2'-EOE | Uw |
| 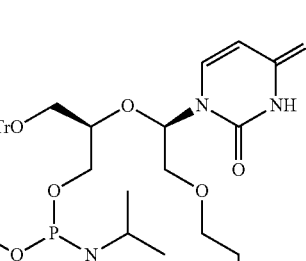 | UNA with 2'-methyl acetamide | Ux |
| 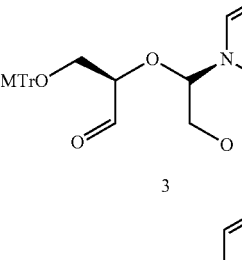 | UNA with 2'-mPEG2 | Uy |

Example 5. Synthesis of Uridine-UNA-2'MOE, 3'Phosphoramidite

Uridine-UNA-2'MOE, 3'Phosphoramidite is synthesized according to the following schemes.

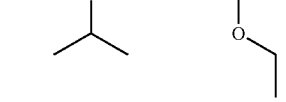
→ DMTrCl, Py, 0-25° C., 3 h, 78.2% yield

1

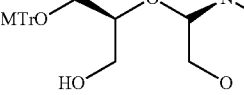
→ NaH₄, dioxane, H₂O, 25° C., 2 H, crude

2

→ NaBH₄, dioxane, 0-20° C., 1 h, 99.3% yield

3

→ Liprozyme TLIM (60% W), benzyl benzoate, tol. 20-40° C., 4 h, crude

4

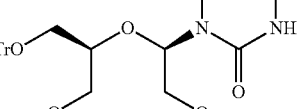
→ TBSCl, Py .25° c. 8 h, 44.5% yield

5

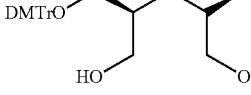
→ Br-CH₂CH₂-OMe (a), NaH (60% purity), DMF, 0~10° C., 16 h 38.1% yield

6

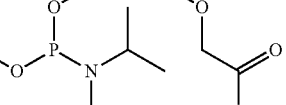
→ NH₄F, MeOH, 20-40° C., 16 h 59.4% yield

7

113

-continued

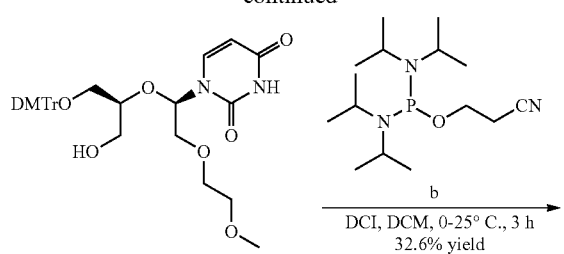

11

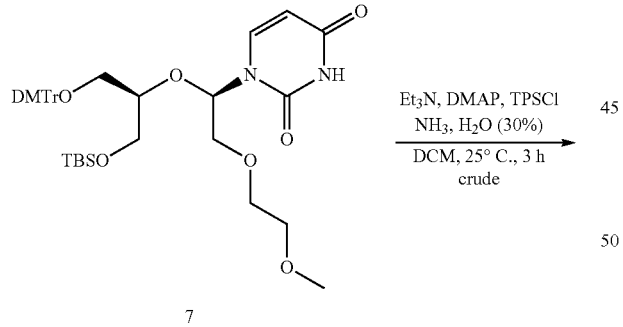

U-UNA-2'MOE 3'Phosphoramidite

Example 6. Synthesis of Cytosine-UNA-2'MOE, 3'Phosphoramidite

Cytosine-UNA-2'MOE, 3'Phosphoramidite is synthesized according to the following schemes.

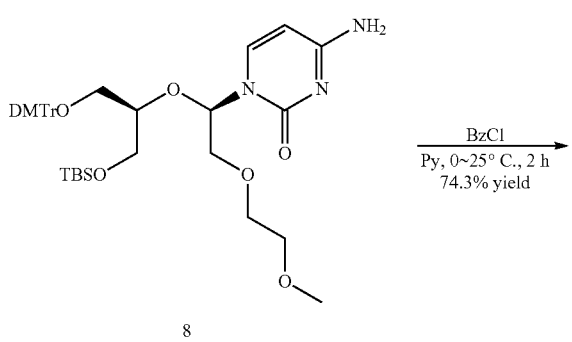

114

-continued

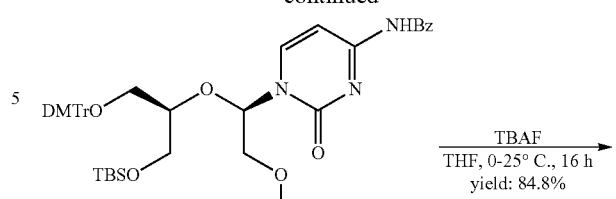

9

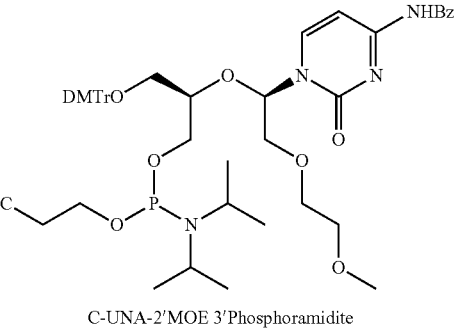

10

C-UNA-2'MOE 3'Phosphoramidite

Example 7. Synthesis of Adenine-UNA-2'MOE, 3'Phosphoramidite

Adenine-UNA-2'MOE, 3'Phosphoramidite is synthesized according to the following schemes.

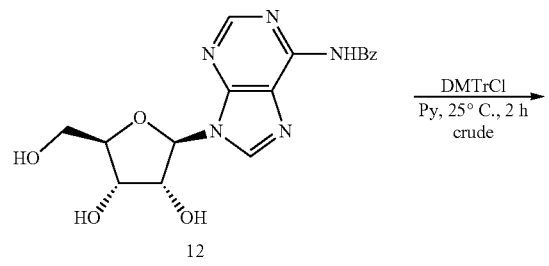

12

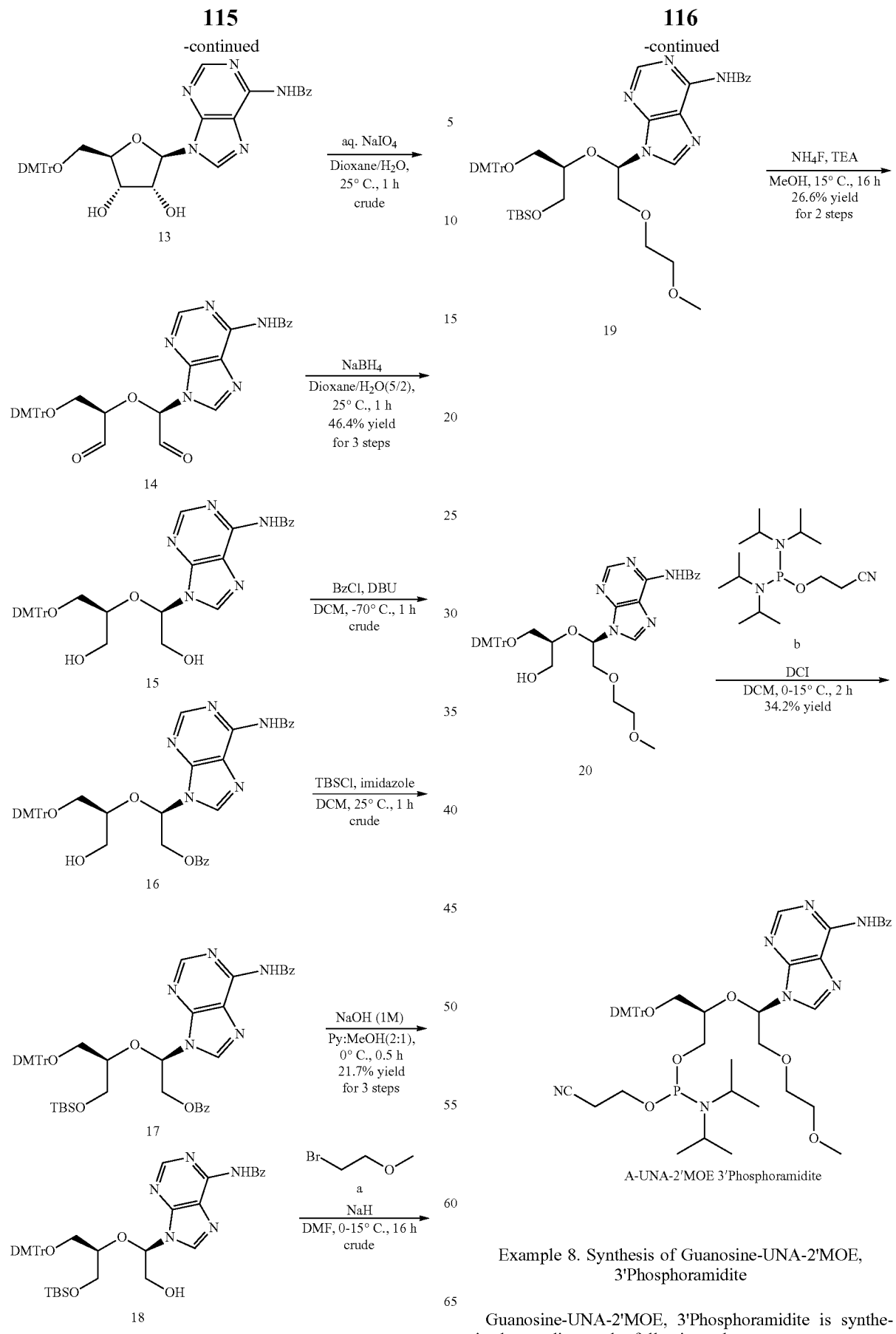
Example 8. Synthesis of Guanosine-UNA-2'MOE, 3'Phosphoramidite
Guanosine-UNA-2'MOE, 3'Phosphoramidite is synthesized according to the following schemes.

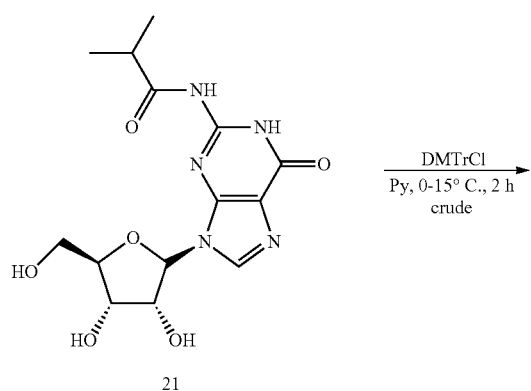
21
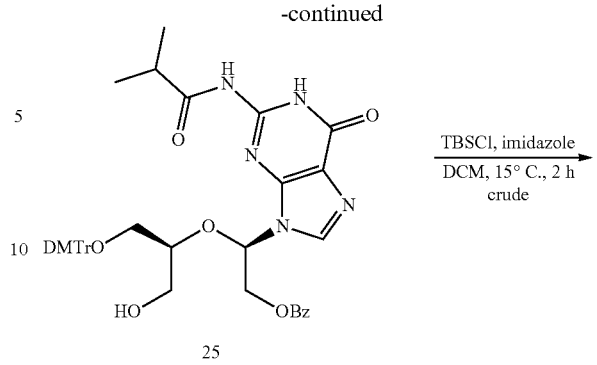
25
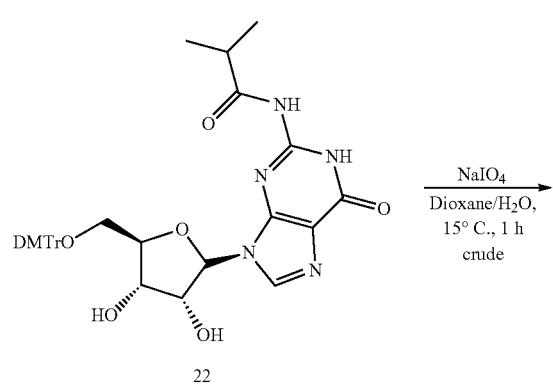
22
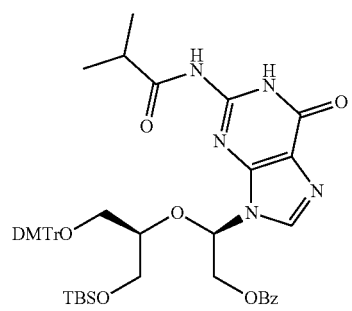
26
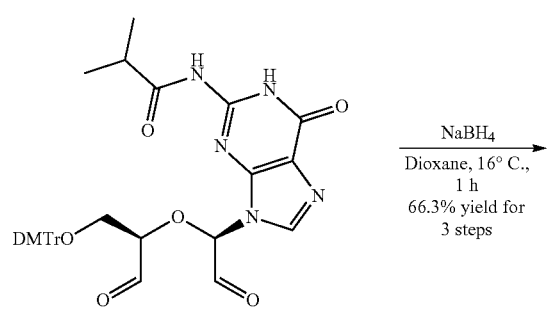
23
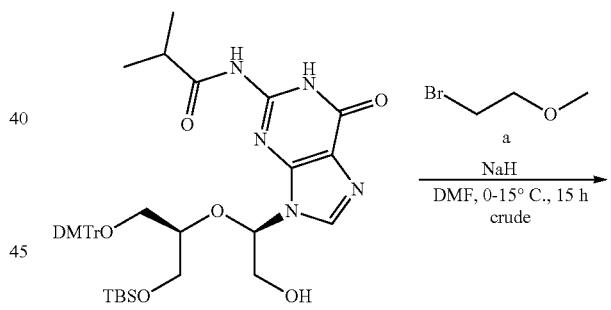
27
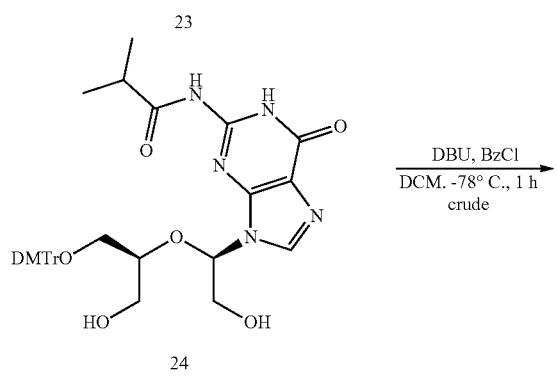
24
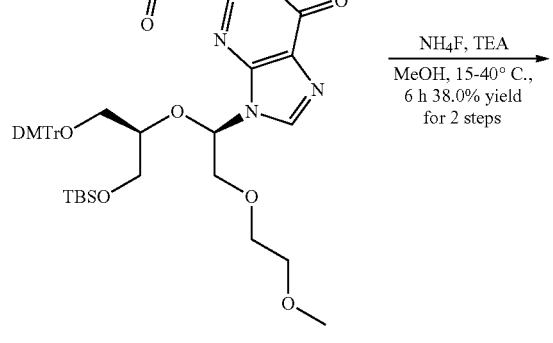
28

-continued

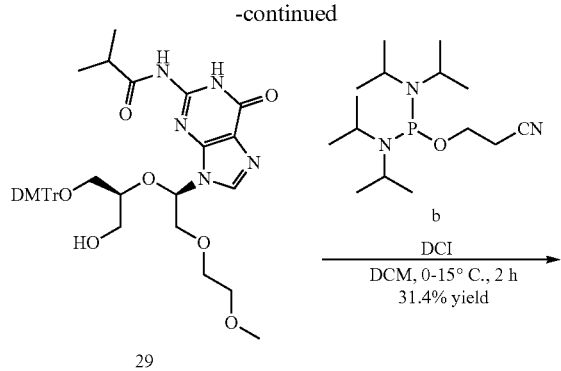

29

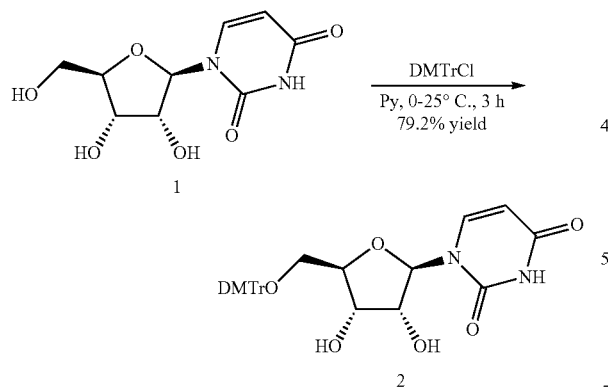

G-UNA-2'MOE 3'Phosphoramidite

Example 9. General Procedure for Preparation of Compound 2

To a solution of compound 1 (350 g, 1.43 mol, 1.00 eq) in Py (2.1 L), was added DMTC1 (500.2 g, 1.48 mol, 1.03 eq) at 0° C. The reaction mixture was stirred at 25° C. for 3 h. TLC (Dichloromethane:Methanol=10:1, Rf=0.51) showed no starting material. The mixture was diluted with aq·NaHCO₃(2.0 L) and extracted with DCM (2.0 L×2), dried over anhydrous Na2SO4, filtered and concentrated under reduced pressure to give a residue. Concentrate the combined organic layer to give the crude product. The residue was purified by column chromatography (SiO2, Petroleum ether/Ethyl acetate=10/1 to 0/1 and 0.5% TEA). Afforded compound 2 (620 g, 1.13 mol, 79.2 yield) as yellow solid.

Example 10. General Procedure for Preparation of Compound 3

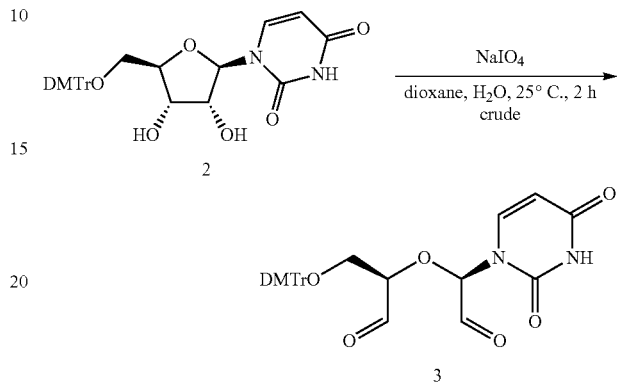

To a solution of compound 2 (310 g, 567.2 mmol, 1.00 eq) in dioxane (1.5 L), was added NaIO₄ (121.3 g, 567.2 mmol, 31.4 mL, 1.00 eq) and H₂O (600 mL) at 25° C., the reaction mixture was stirred at 25° C. for 2 h. TLC (Dichloromethane:Methanol=10:1, Rf=0.64) showed starting material was consumed completely. The two reactions were combined for workup. The reaction mixture was filtered. The crude product was used into the next step without further purification. Afforded compound 3 (600 g, crude) as a colorless oil.

Example 11. General Procedure for Preparation of Compound 4

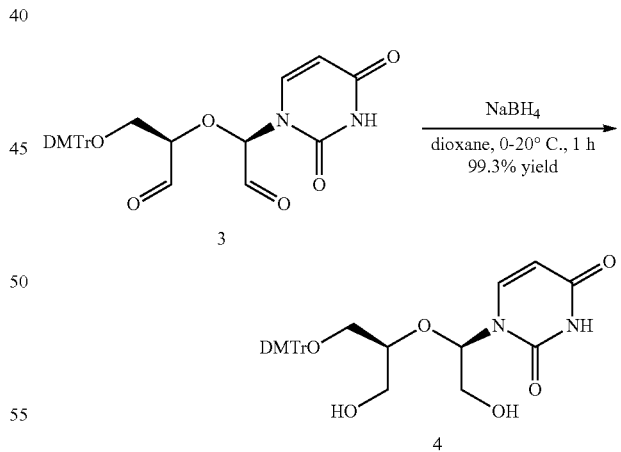

To a solution of compound 3 (300 g, 550.9 mmol, 1 eq) in dioxane (1.8 L), was added NaBH₄ (20.8 g, 550.9 mmol, 1.00 eq) at 0° C., the mixture was stirred at 20° C. for 1 h. TLC (Dichloromethane:Methanol=10:1, Rf=0.43) showed no starting material. The two reactions were combined for workup; the reaction mixture was quenched by acetone, neutralized with 20% acetic acid aq., and concentrated to give a residue. The residue was diluted with DCM (1.8 L), and washed with H₂O (1.8 L), dried over anhydrous

Example 12. General Procedure for Preparation of Compound 5

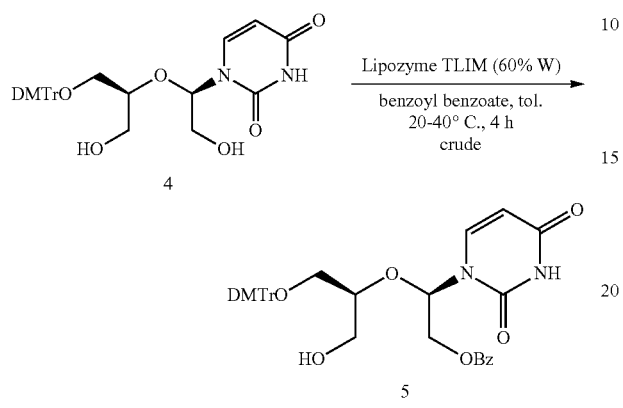

To a solution of compound 4 (300 g, 546.9 mmol, 1.00 eq) in Tol. (600 mL) was added lipozyme TL IM (60 g, 0.60 eq) and Benzoyl benzoate (124.9 g, 552.3 mmol, 104.1 mL, 1.01 eq) at 20° C. The reaction mixture was stirred at 40° C. for 4 h. TLC (Dichloromethane:Methanol=10:1, $R_f$=0.53) showed no starting material. Combined the two reactions for workup, the reaction mixture was filtered, the filter liquor was partitioned between aqueous $NaHCO_3$ (600 mL) and EtOAc (600 mL). The organic phase was separated, washed with brine (600 mL×3), dried over anhydrous $Na_2SO_4$, filtered and concentrated under reduced pressure. Afforded compound 5 (620 g, crude) as white solid.

Example 13. General Procedure for Preparation of Compound 6

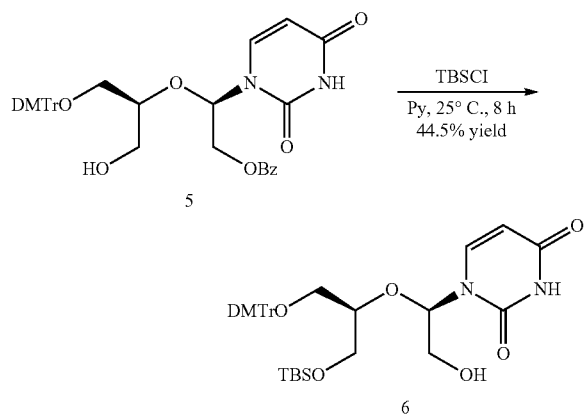

To a solution of compound 5 (310 g, 475.0 mmol, 1.00 eq) in Py (1.8 L) was added TBSCl (85.9 g, 569.9 mmol, 69.8 mL, 1.20 eq). The reaction mixture was stirred at 25° C. for 8 h. Two batches were combined for working up and purification. Aq·$NaHCO_3$ (1.8 L) was added and the mixture was extracted with DCM (1.8 L), concentrated in vacuum to give a residue. The residue was dissolved in Py (1.2 L) and MeOH (5.4 L), then added 1M NaOH in MeOH (300 mL) dropwise in mixture at 0° C., and then stirred for 1 h at 0° C. TLC (Petroleum ether: Ethyl acetate=1:1, $R_f$=0.43) showed no starting material. Sat. aq $NH_4Cl$ (1.2 L) was added to the mixture, which was stirred for 10 min, $H_2O$ (1.2 L) was added and the mixture which was extracted with DCM (3 L). Dried over anhydrous $Na_2SO_4$, filtered and concentrated under reduced pressure to give a residue. The residue was purified by column chromatography ($SiO_2$, Petroleum ether/Ethyl acetate=10/1 to 0/1 and 0.5% TEA). Afforded compound 6 (280 g, 422.4 mmol, 44.5% yield) as yellow oil.

Example 14. General Procedure for Preparation of Compound 7

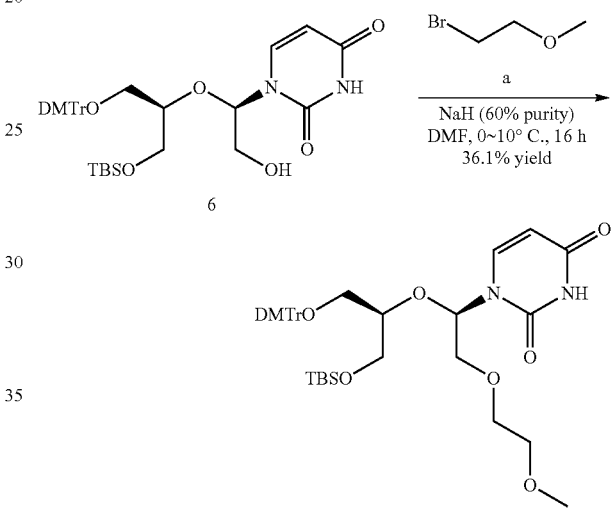

To a solution of NaH (27.9 g, 697.0 mmol, 60% purity, 3.30 eq) in DMF (850 mL), was added compound 6 (140 g, 211.2 mmol, 1.00 eq) at 0° C., the reaction mixture was stirred at 0° C. for 1 h, and then was added compound a (44.0 g, 316.8 mmol, 29.8 mL, 1.50 eq) at 0° C., the reaction mixture was stirred at 10° C. for 16 h. TLC (Petroleum ether: Ethyl acetate=1: 2, $R_f$=0.43) showed no starting material. Two batches were combined for working up and purification. Dilute the residue with aq·$NH_4Cl$ (4.2 L), and extracted with EtOAc (1.0 L×2), combined organic layers were washed with brine (1.0 L), dried over anhydrous $Na_2SO_4$ and filtered. The filtrate was concentrated under reduced pressure to give a residue. The residue were purified by column chromatography ($SiO_2$, Petroleum ether/Ethyl acetate=10/1 to 0:1 and 0.5% TEA). Afforded compound 7 (110 g, 152.6 mmol, 36.1% yield) as yellow oil.

$^1$H NMR: ET32436-23-P1A (400 MHz, DMSO-$d_6$)

δ 11.37 (s, 1H), 7.70 (d, J=8.0 Hz, 1H), 7.33-7.30 (m, 4H), 7.19-7.16 (m, 5H), 6.86-6.84 (m, 4H), 6.00 (t, J=4.8 Hz, 1H), 5.55 (d, J=8.0 Hz, 1H), 3.73 (s, 6H), 3.71-3.69 (m, 2H), 3.65-3.63 (m, 2H), 3.56-3.55 (m, 3H), 3.41-3.39 (m, 2H), 3.21 (s, 3H), 2.97-2.95 (m, 2H), −0.76 (s, 9H), −0.04 (d, J=7.6 Hz, 6.0H)

Example 15. General Procedure for Preparation of Compound 11

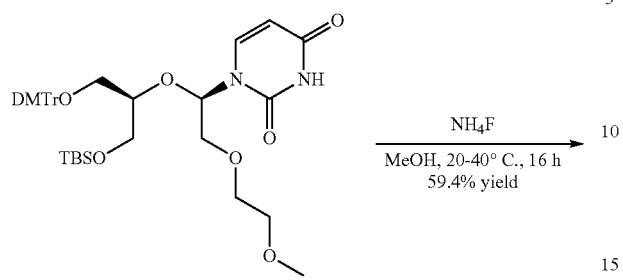

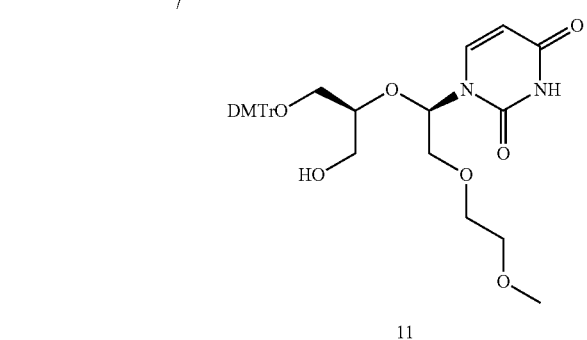

To a solution of compound 7 (15 g, 20.8 mmol, 1.00 eq) in MeOH (120 mL) was added NH$_4$F (6.17 g, 166.5 mmol, 8.00 eq) at 20° C., the reaction mixture was stirred at 40° C. for 16 h. TLC (Petroleum ether: Ethyl acetate=0:1, R$_f$=0.13) showed no starting material. The reaction mixture was concentrated under reduced pressure to give a residue. The residue was purified by column chromatography (SiO$_2$, Petroleum ether/Ethyl acetate=10/1 to 0:1 and 0.5% TEA). Afforded compound 11 (7.50 g, 12.4 mmol, 59.4% yield) as yellow oil.

$^1$H NMR: ET32436-28-PIA (400 MHz, DMSO-d$_6$)
δ 11.39 (s, 1H), 7.68 (d, J=8.0 Hz, 1H), 7.32-7.28 (m, 4H), 7.20-7.16 (m, 5H), 6.87-6.85 (m, 4H), 5.98 (t, J=6.0 Hz, 1H), 5.54 (d, J=4.0 Hz, 1H), 4.74 (t, J=5.2 Hz, 1H), 3.73 (s, 7H), 3.71 (s, 1H), 3.63-3.59 (m, 1), 3.51-3.55 (m, 2), 3.42-3.41 (m, 4H), 3.21 (s, 3H), 3.00-2.94 (m, 2H).

Example 16. General Procedure for Preparation of U-UNA-2'MOE 3'Phosphoramidite

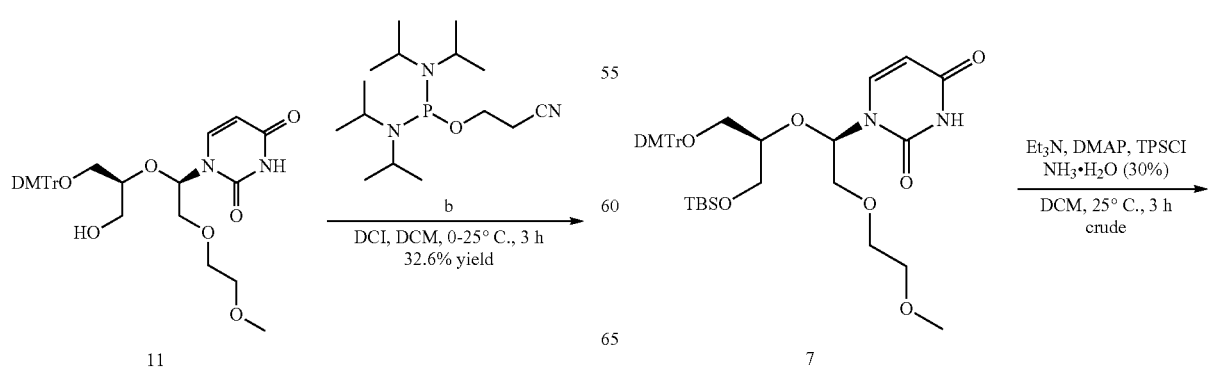

To a solution of compound 11 (8.0 g, 13.2 mmol, 1.00 eq) in DCM (48.0 mL) was added 1H-imidazole-4,5-dicarbonitrile (2.34 g, 19.8 mmol, 1.50 eq) at 0° C., and then compound b (6.76 g, 22.4 mmol, 7.12 mL, 1.70 eq) was added. The reaction mixture was stirred at 25° C. for 3 h. TLC (Dichloromethane:MeOH=10:1, R$_f$=0.53) showed no starting material. The reaction mixture was purified by column chromatography (SiO$_2$, Petroleum ether/Ethyl acetate=2/1-1/2, 1% TEA). Combine with (ET32436-32-P1) for purification: Column: Agela DuraShell C18 250*80 mm*10 um; mobile phase: [water (10 mM NH$_4$HCO$_3$)-ACN]; B %: 40%-80%, 20 min. Afforded compound U-UNA-2'MOE 3'Phosphoramidite as yellow solid.

$^1$H NMR: (400 MHz, DMSO-d$_6$): δ 11.40 (br s, 1H), 7.68 (d, J=8.0 Hz, 1H), 7.32-7.29 (m, 4H), 7.20-7.16 (m, 5H), 6.86-6.84 (m, 4H), 5.99-5.96 (m, 1H), 5.56 (d, J=8.0 Hz, 1H), 3.73 (s, 7H), 3.70-3.65 (m, 4H), 3.56-3.55 (m, 5H), 3.40-3.39 (m, 2H), 3.21 (s, 3H), 3.09-2.94 (m, 2H), 2.72-2.69 (m, 2H), 1.17-0.96 (m, 12H).

$^{31}$PNMR: (162 MHz, DMSO-d$_6$): δ 147.46

HPLC: 97.3% purity

MS: M−1=805.3

Example 17. General Procedure for Preparation of Compound 8

-continued

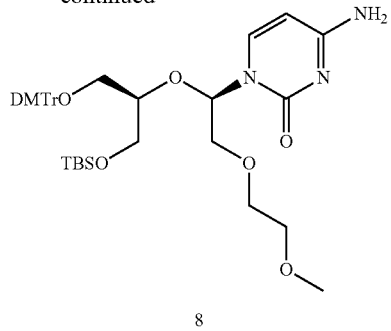

8

To a solution of compound 7 (50 g, 69.4 mmol, 1.00 eq) in DCM (300 mL) and TEA (17.6 g, 173.4 mmol, 24.13 mL, 2.50 eq), was added DMAP (8.47 g, 69.4 mmol, 1.00 eq) and TPSCl (51.1 g, 173.4 mmol, 2.50 eq). The reaction mixture was stirred at 25° C. for 1 h, and then was added NH$_3$·H$_2$O (81.03 g, 693.6 mmol, 89.0 mL, 30% purity, 10.0 eq) and stirred at 25° C. for 2 h. TLC (Dichloromethane:Methanol=10:1, R$_f$=0.23) showed no starting material. The reaction mixture was extracted in EtOAc (300 mL) and washed with sat·NaHCO$_3$ and brine (200 mL each). Organic layer was dried over anhydrous Na$_2$SO$_4$, filtered and concentrated under reduced pressure to give a residue. Afforded compound 8 (50 g, crude) as yellow oil.

Example 17. General Procedure for Preparation of Compound 9

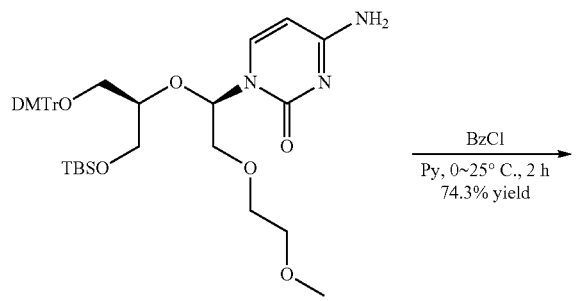

To a solution of compound 8 (40 g, 55.6 mmol, 1.00 eq) in Py (240 mL), was added BzCl (11.7 g, 83.3 mmol, 9.68 mL, 1.50 eq) at 0° C., the reaction mixture was stirred 25° C. for 2 h. TLC (Dichloromethane:Methanol=10:1, R$_f$=0.43) showed no starting material. The mixture was diluted with aq·NaHCO$_3$ (500 mL) and extracted with DCM (500 mL×2), dried over anhydrous Na$_2$SO$_4$, filtered and concentrated under reduced pressure to give a residue. Concentrate the combined organic layer to give the crude product. The residue was purified by column chromatography (SiO$_2$, Petroleum ether/Ethyl acetate=10/1 to 0/1 and 0.5% TEA). Afforded compound 9 (34.0 g, 41.3 mmol, 74.3% yield) as yellow oil $^1$H NMR: (400 MHz, DMSO-d$_6$) δ 11.36 (s, 1H), 8.58-8.57 (m, 1H), 8.20-8.18 (m, 1H), 8.04-8.02 (m, 2H), 7.64-7.51 (m, 3H), 7.38-7.15 (m, 12H), 6.86-6.83 (m, 4H), 6.16 (t, J=5.2 Hz, 1H), 3.73-3.69 (m, 4H), 3.67 (s, 6H), 3.60-3.52 (m, 4H), 3.42-3.39 (m, 2H), 3.21-3.19 (m, 3H), 3.00-2.99 (m, 2H), 0.77 (s, 9H), −0.03 (d, J=8.0 Hz, 6H).

Example 18. General Procedure for Preparation of Compound 10

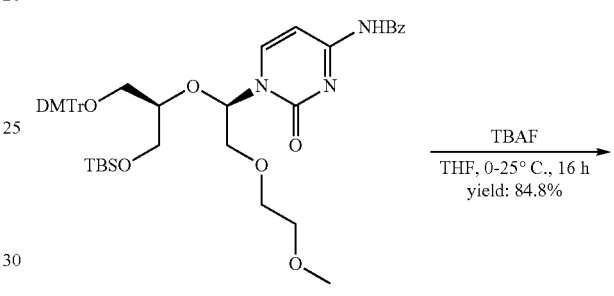

9

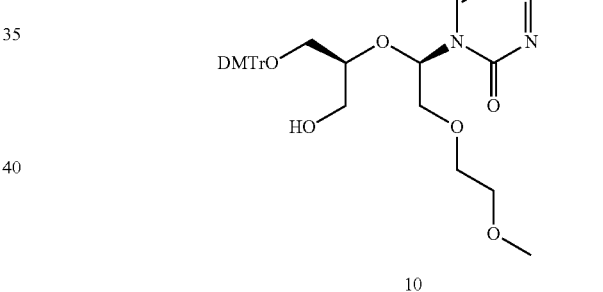

10

To a solution of compound 9 (30 g, 36.4 mmol, 1.00 eq) in THF (300 mL), was added TBAF (1 M, 40.1 mL, 1.10 eq) at 0° C., the reaction mixture was stirred at 25° C. for 16 h. TLC (Dichloromethane:Methanol=10:1, R$_f$=0.24) showed no starting material. The mixture was diluted with aq·NaHCO$_3$ (600 mL) and extracted with DCM (500 mL×2), dried over anhydrous Na$_2$SO$_4$, filtered and concentrated under reduced pressure to give a residue. Concentrate the combined organic layer to give the crude product. The residue was purified by column chromatography (SiO$_2$, Petroleum ether/Ethyl acetate=10/1 to 0:1 and 0.5% TEA). Afforded compound 10 (16.5 g, 23.3 mmol, 63.9% yield) as yellow oil.

$^1$H NMR: (400 MHz, DMSO-d$_6$) δ 11.36 (s, 1H), 8.20 (d, J=7.2 Hz, 1H), 8.03 (d, J=7.6 Hz, 2H), 7.64 (t, J=7.4 Hz, 1H), 7.55-7.51 (m, 2H), 7.37 (d, J=7.2 Hz, 1H), 7.31-7.29 (m, 4H), 7.17 (d, J=8.8 Hz, 5H), 6.86 (d, J=8.8 Hz, 4H), 6.17 (t, J=4.8 Hz, 1H), 4.77 (t, J=5.4 Hz, 1H), 3.76-3.74 (m, 2H), 3.68 (s, 7H), 3.60-3.58 (m, 2H), 3.46-3.39 (m, 4H), 3.20 (s, 3H), 3.05-2.96 (m, 2H).

Example 19. General Procedure for Preparation of C-UNA-2'MOE 3'Phosphoramidite

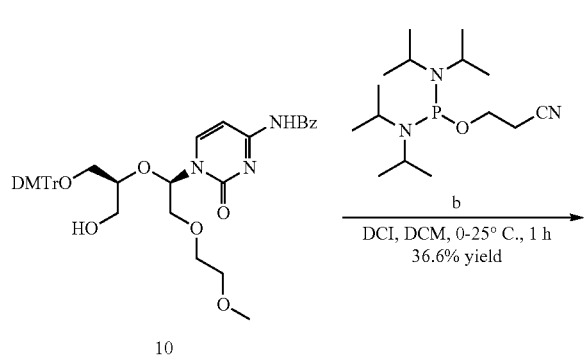

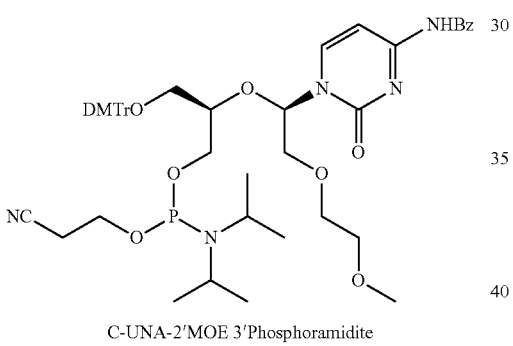

C-UNA-2'MOE 3'Phosphoramidite

To a solution of compound 10 (13.3 g, 18.7 mmol, 1.00 eq) in DCM (130 mL) was added 1H-imidazole-4,5-dicarbonitrile (3.32 g, 28.1 mmol, 1.50 eq) at 0° C., and then compound b (9.60 g, 31.9 mmol, 10.1 mL, 1.70 eq) was added. The reaction mixture was stirred at 25° C. for 1 h. TLC (Petroleum ether: Ethyl acetate=1:1, $R_f$=0.43) showed no starting material. The reaction mixture was purified by column chromatography (SiO$_2$, Petroleum ether/Ethyl acetate=1/1-0/1, 5% TEA). Afforded compound C-UNA-2'MOE 3'Phosphoramidite as white solid.

$^1$H NMR: (400 MHz, DMSO-d$_6$)

δ 11.37 (s, 1H), 8.19 (d, J=6.8 Hz, 1H), 8.03 (d, J=7.6 Hz, 2H), 7.64 (t, J=7.4 Hz, 1H), 7.53 (t, J=7.6 Hz, 2H), 7.36 (d, J=7.2 Hz, 11H), 7.29-7.26 (m, 4H), 7.18-7.15 (m, 5H), 6.85 (d, J=8.4 Hz, 4H), 6.15 (s, 1H), 3.87-3.68 (m, 11H), 3.64-3.57 (m, 4H), 3.54-3.44 (m, 2H), 3.40 (s, 2H), 3.20 (s, 3H), 3.12-2.30 (m, 2H), 2.74-2.69 (m, 2H), 1.12-1.10 (m, 6H), 1.05-1.01 (m, 6H)

$^{31}$PNMR: (162 MHz, DMSO-d$_6$): δ (147.57

HPLC: 98.4% purity

MS: M−1=909.3

Example 20. General Procedure for Preparation of Compound 13

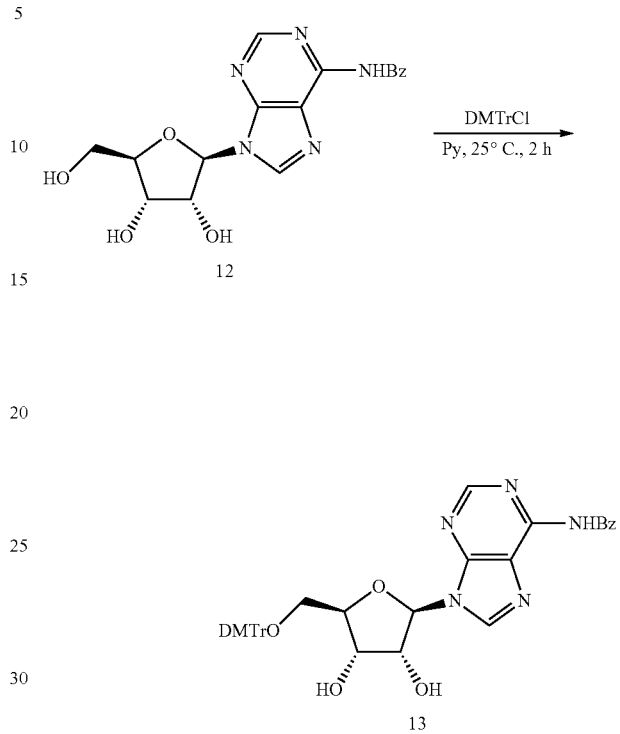

To a solution of compound 12 (200 g, 539 mmol, 1.00 eq) in Py (2.00 L) was added DMTC1 (200 g, 592 mmol, 1.10 eq), then stirred at 25° C. for 2 h. TLC (Dichloromethane: Methanol=20: 1, $R_f$=0.44) showed no starting material. The reaction mixture was added MeOH (150 mL), then concentrated in vacuum. The residue was dissolved in EtOAc (2.00 L), washed with aq·actric acid (500 mL×2) and brine (500 mL), dried with anhydrous Na$_2$SO$_4$, filtered and concentrated in vacuum. The residue was washed with MTBE (1.00 L×2). Afforded compound 13 (280 g, crude) as yellow solid.

$^1$H NMR: (400 MHz, DMSO-d$_6$): δ 11.18 (s, 1H), 8.68 (s, 1H), 8.58 (s, 1H) 8.04 (d, J=7.2 Hz, 1H), 7.65-7.63 (m, 1H), 7.57-7.53 (m, 2H), 7.37-7.36 (m, 2H) 7.20-7.28 (m, 10H), 7.07-7.09 (m, 2H), 6.85-6.82 (m, 6H), 6.07 (d, J=4.0 Hz, 1H), 5.61 (d, J=4.0 Hz, 1H), 5.24 (d, J=4.0 Hz, 1H), 4.79-4.78 (m, 1H), 4.34-4.32 (m, 1H), 4.12-4.11 (m, 11H), 3.74-3.72 (m, 9H), 3.26-3.25 (m, 2H).

Example 21. General Procedure for Preparation of Compound 14

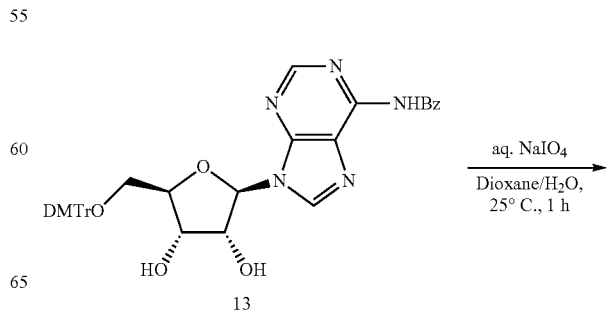

-continued

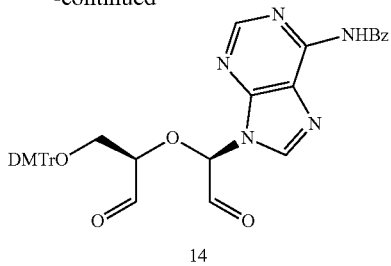

14

To a solution of compound 13 (80.0 g, 119 mmol, 1.00 eq) in Dioxane (1.20 L) was added the solution of NaIO$_4$ (27.9 g, 130 mmol, 7.24 mL, 1.10 eq) in H$_2$O (400 mL) at 25° C., then stirred at 25° C. for 1 h. TLC (Dichloromethane:Methanol=15:1, R$_f$=0.32) showed no starting material. The three batches were combined for working up and purification. The reaction mixture was filtered and the filtrate was used for next directly. Afforded compound 14 (240 g, crude) as yellow oil. The crude was used for next directly.

Example 22. General Procedure for Preparation of Compound 15

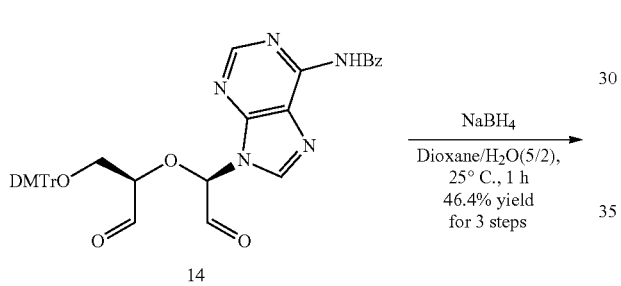

To a solution of compound 14 (80.0 g, 119 mmol, 1.00 eq) in dioxane (1.20 L) was added NaBH$_4$ (4.96 g, 131 mmol, 1.10 eq) at 25° C., then stirred at 25° C. for 1 h. TLC (Dichloromethane:Methanol=15:1, R$_f$=0.34) showed no starting material. The reaction mixture was added AcOH/Py (1/1, 50.0 mL), then concentrated in vacuum. The three batches were combined with ET32454-7-PIA for working up and purification. The residue was extracted with EtOAc (1.00 L×2), washed with aq·NaHCO$_3$ (600 mL) and brine (600 mL), dried with anhydrous Na$_2$SO$_4$, filtered and concentrated in vacuum. The residue was purified by column chromatography (SiO$_2$, DCM:MeOH=50:1 to 10:1, 1% TEA). Afforded compound 15 (230.0 g, 46.4% yield for 3 steps) as yellow solid.

LCMS: RT=2.213 min, M−1=674.3.

$^1$H NMR: (400 MHz, DMSO-d$_6$)

δ 11.25 (s, 1H), 8.75 (s, 1H), 8.67 (s, 1H), 8.07-80.5 (m, 2H), 7.67-7.63 (m, 1H), 7.57-7.53 (m, 2H), 7.22-7.12 (m, 3H), 7.07-7.05 (m, 1H), 6.97-6.93 (m, 4H), 6.79-6.77 (m, 4H), 6.05 (t, J=12 Hz, 1H), 5.31-5.26 (m, 1H), 4.83 (t, J=8.0 Hz, 1H), 4.14-4.04 (m, 2H), 3.84 (s, 1H), 3.69 (s, 6H), 3.49-3.47 (m, 2H), 2.89-2.78 (m, 1H), 2.77-2.75 (m, 1H).

Example 22. General Procedure for Preparation of Compound 16

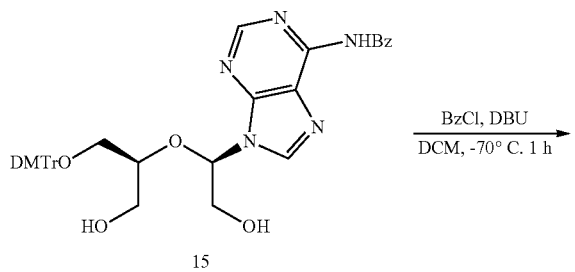

To a solution of compound 15 (145 g, 214 mmol, 1.00 eq) in DCM (2.00 L) was added DBU (65.3 g, 429 mmol, 64.7 mL, 2.00 eq), then cooled to −70° C. and added BzCl (33.2 g, 236 mmol, 27.4 mL, 1.10 eq) dropwise at −70° C., then stirred at −70° C. for 1 h. TLC (Dichloromethane:Methanol=10:1, R$_f$=0.43) showed no starting material. The reaction mixture was added EtOH (300 mL) at −70° C., then allowed to 25° C., washed with aq·NaHCO$_3$ (2.00 L×2) and brine (1.00 L), dried over anhydrous Na$_2$SO$_4$, filtered and concentrated in vacuum. Afforded compound 16 (160 g, crude) as yellow solid. The crude was used for next directly.

Example 23. General Procedure for Preparation of Compound 17

-continued

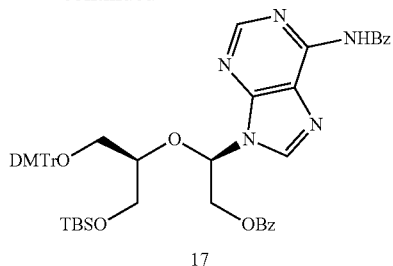

17

To a solution of compound 16 (160 g, 205 mmol, 1.00 eq) in DCM (960 mL) was added imidazole (21.0 g, 308 mmol, 1.50 eq) and TBSCl (40.2 g, 267 mmol, 32.7 mL, 1.30 eq), then stirred at 25° C. for 1 h. TLC (Dichloromethane: Methanol=10:1, R$_f$=0.51) showed no starting material. The reaction mixture was washed with aq·NaHCO$_3$ (800 mL×2) and brine (800 mL×2), dried with anhydrous Na$_2$SO$_4$, filtered and concentrated in vacuum. Afforded compound 17 (160 g, crude) as yellow solid. The crude was used for next directly.

Example 23. General Procedure for Preparation of Compound 18

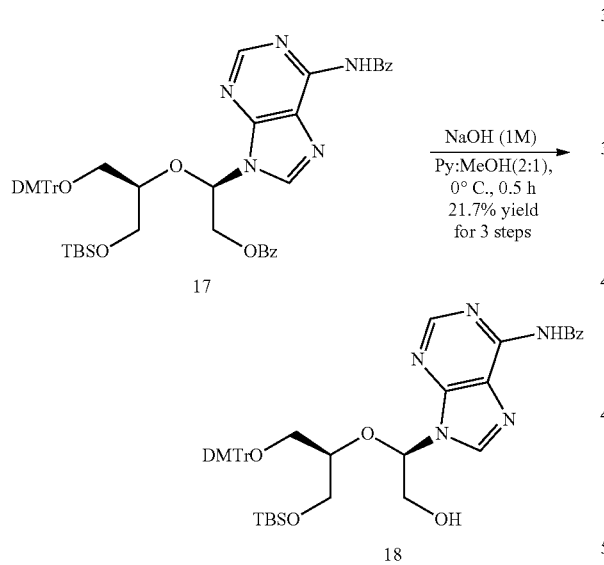

To a solution of compound of 17 (200 g, 224 mmol, 1.00 eq) in Py (1.20 L) and MeOH (480 mL) was added NaOH (1 M, 224 mL, 1.00 eq) dropwise at 0° C., then stirred at 0° C. for 0.5 h. TLC (Dichloromethane:Methanol=10:1, R$_f$=0.42) showed no starting material. The reaction mixture was extracted with EtOAc (1.00 L×2), washed with aq·NH$_4$Cl (1.00 L×2) and brine (800 mL), dried with anhydrous Na$_2$SO$_4$, filtered and concentrated in vacuum. ET32454-18-P1A was combined with ET32454-19-PIA for purification. The residue was purified by column chromatography (SiO$_2$, Petroleum ether/Ethyl acetate=10/1 to DCM:MeOH=20:1, 1% TEA). Afforded compound 18 (58 g, 21.7% yield for 3 steps) as white solid.

$^1$H NMR: (400 MHz, DMSO-d$_6$) δ 11.24 (s, 1H), 8.75 (s, 1H), 8.70 (s, 1H), 8.07-8.05 (m, 2H), 7.69-7.65 (m, 1H), 7.59-7.56 (m, 2H), 7.24-7.20 (m, 2H), 7.17-7.13 (m, 1H), 7.08-7.06 (m, 1H), 6.99-6.94 (m, 4H), 6.81-6.78 (m, 4H), 6.07-6.04 (m, 1H), 5.30-5.27 (t, J=12 Hz, 1H), 4.20-4.14 (m, 1H), 4.06-3.99 (m, 1H), 3.88-3.85 (m, 1H), 3.76-3.70 (m, 7H), 3.61-3.57 (m, 1H), 0.80 (s, 9H), 0.03 (d, J=12 Hz, 6H).

Example 24. General Procedure for Preparation of Compound 19

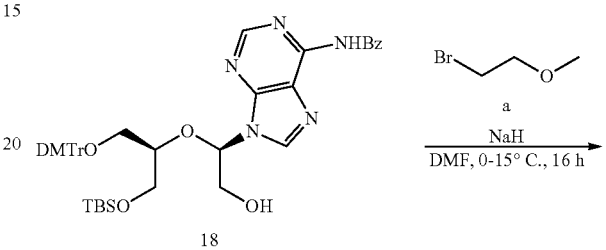

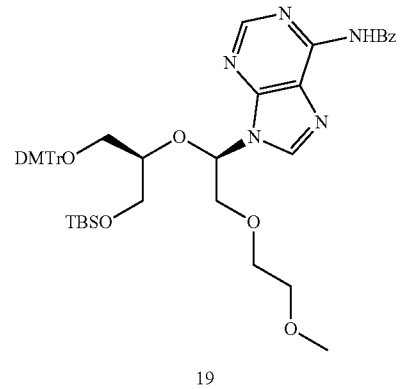

19

To a solution of NaH (9.52 g, 238 mmol, 60% purity, 3.30 eq) in DMF (300 mL) was added the solution of compound 18 (57.0 g, 72.2 mmol, 1.00 eq) dropwise at 0° C., then stirred at 0° C. for 1 h. The mixture was added compound a (15.0 g, 108 mmol, 10.2 mL, 1.50 eq) dropwise at 0° C., and then stirred at 15° C. for 15 h. TLC (Dichloromethane: Methanol=10:1, R$_f$=0.43) showed no starting material. The reaction mixture was poured into aq·NH$_4$Cl (2.00 L), extracted with EtOAc (800 mL×2), washed with brine (500 mL×2), dried with anhydrous Na$_2$SO$_4$, filtered and concentrated in vacuum. Afforded compound 19 (60.0 g, crude) as yellow oil. The crude was used for next directly.

LCMS: RT=3.219 min, MS-1=846.4.

Example 25. General Procedure for Preparation of Compound 20

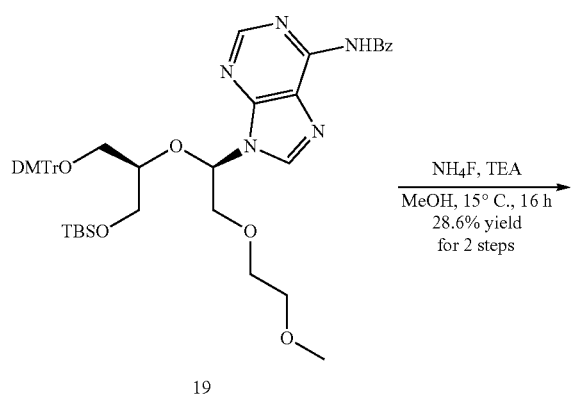

Example 26. General Procedure for Preparation of A-UNA-2'MOE 3'Phosphoramidite

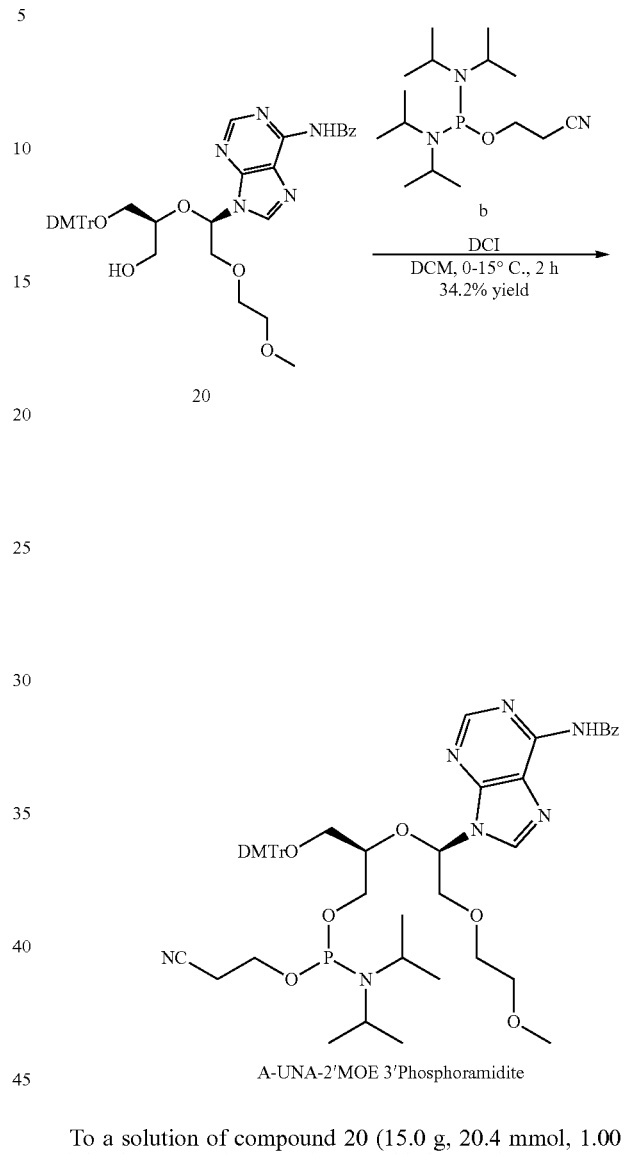

To a solution of compound 19 (60.0 g, 70.8 mmol, 1.00 eq) in MeOH (360 mL) was added NH$_4$F (21.0 g, 566 mmol, 8.00 eq) and TEA (14.3 g, 142 mmol, 19.7 mL, 2.00 eq) at 15° C., then stirred at 15° C. for 16 h. TLC (Dichloromethane:Methanol=10:1, R$_f$=0.33) showed no starting material. The reaction mixture was concentrated in vacuum. The residue was purified by column chromatography (SiO$_2$, DCM:MeOH=100:1 to 10:1, 1% TEA). Afforded compound 20 (16.5 g, 22.5 mmol, 28.6% yield) as white solid.

$^1$H NMR: (400 MHz, DMSO-d$_6$) δ 11.24 (s, 1H), 8.76 (s, 1H), 8.71 (s, 1H), 8.07-8.05 (m, 2H), 7.69-7.65 (m, 1H), 7.59-7.56 (m, 2H), 7.24-7.20 (m, 2H), 7.17-7.13 (m, 1H), 7.08-7.06 (m, 1H), 6.99-6.94 (m, 4H), 6.81-6.78 (m, 4H), 6.25-6.22 (m, 1H), 4.84-4.82 (t, J=6 Hz, 1H), 4.30-4.25 (m, 1H), 4.09-4.05 (m, 1H), 3.87-3.85 (m, 1H), 3.69 (d, J=2 Hz, 7H), 3.62-3.60 (m, 2H), 3.50-3.47 (m, 2H), 3.39-3.37 (m, 2H), 3.17 (s, 3H), 2.90-2.86 (m, 1H), 2.77-2.73 (m, 1H).

To a solution of compound 20 (15.0 g, 20.4 mmol, 1.00 eq) in dry DCM (90.0 mL) was added DCI (3.62 g, 30.7 mmol, 1.50 eq) and compound b (10.5 g, 34.8 mmol, 11.0 mL, 1.70 eq) at 0° C., then stirred at 15° C. for 2 h. TLC (Dichloromethane:Acetone=3:1, R$_f$=0.53) showed no starting material. The solution was poured into the silica gel column directly. The reaction mixture was purified by column chromatography (SiO$_2$, Petroleum ether/Ethyl acetate=5/1 to 0/1, 1% TEA). Afforded A-UNA-2'MOE 3'Phosphoramidite (7.00 g, 34.2% yield) as white solid.

$^1$H NMR: (400 MHz, DMSO-d$_6$) δ11.26 (s, 1H), 8.77-8.72 (m, 2H), 8.06 (d, J=7.6 Hz, 2H), 7.63 (t, J=14.8 Hz, 1H), 7.56 (t, J=15.2 Hz, 2H), 7.20-7.12 (m, 3H), 7.08-7.04 (m, 2H), 6.98-6.92 (m, 4H), 6.79-6.76 (m, 4H), 6.22 (t, J=12 Hz, 1H), 4.27-4.24 (m, 1H), 4.04-3.98 (m, 2H), 3.69-3.66 (m, 10H), 3.63-3.62 (m, 2H), 3.62-3.60 (m, 2H), 3.39-3.37 (m, 2H), 3.17 (s, 3H), 2.96-2.71 (m, 4H), 1.19-1.03 (m, 12H).

$^{31}$P NMR: (162 MHz, DMSO-d$_6$) δ 147.62, 147.46
HPLC: 97.8% purity
MS: M-1=932.2

Example 27. General Procedure for Preparation of Compound 22

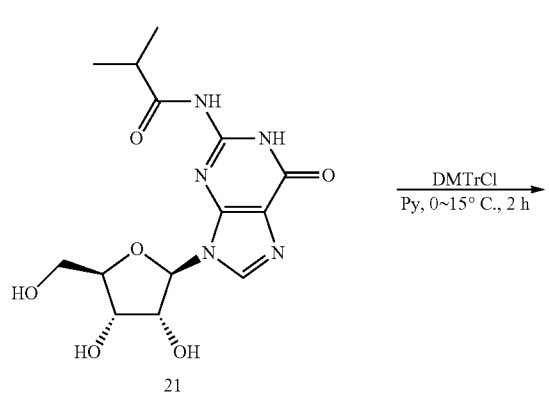

To a solution of compound 21 (150.0 g, 424.5 mmol, 1.00 eq) in Py (900 mL) was added DMTCl (158.2 g, 467.0 mmol, 1.10 eq) at 0° C., then stirred at 15° C. for 2 h. TLC (Dichloromethane:Methanol=20: 1, $R_f$=0.38) showed no starting material. The reaction mixture was added MeOH (150 mL), then concentrated in vacuum. The residue was dissolved in EtOAc (1000 mL), washed with aq·actric acid (500 mL×2) and brine (500 mL), dried with anhydrous Na$_2$SO$_4$, filtered and concentrated in vacuum. The residue was washed with MTBE (1000 mL×2). Afforded compound 22 (284.0 g, crude) as yellow solid.

$^1$H NMR: (400 MHz, DMSO-d$_6$) δ 12.10 (s, 1H), 11.66 (s, 1H), 8.58 (d, J=4.0 Hz, 1H), 8.12 (s, 1H), 7.38-7.35 (m, 3H), 7.33-7.25 (m, 8H), 7.23-7.20 (m, 1H), 6.84-6.80 (m, 4H), 5.86 (d, J=4.8 Hz, 11H), 5.62 (d, J=5.6 Hz, 11H), 5.19 (d, J=5.6 Hz, 11H), 4.54-4.53 (m, 1H), 4.22-4.20 (m, 11H), 3.74-3.72 (m, 7H), 3.25-3.18 (m, 11H), 2.78-2.76 (m, 11H), 2.76-2.75 (m, 1H), 1.13-1.10 (m, 6H).

Example 28. General Procedure for Preparation of Compound 23

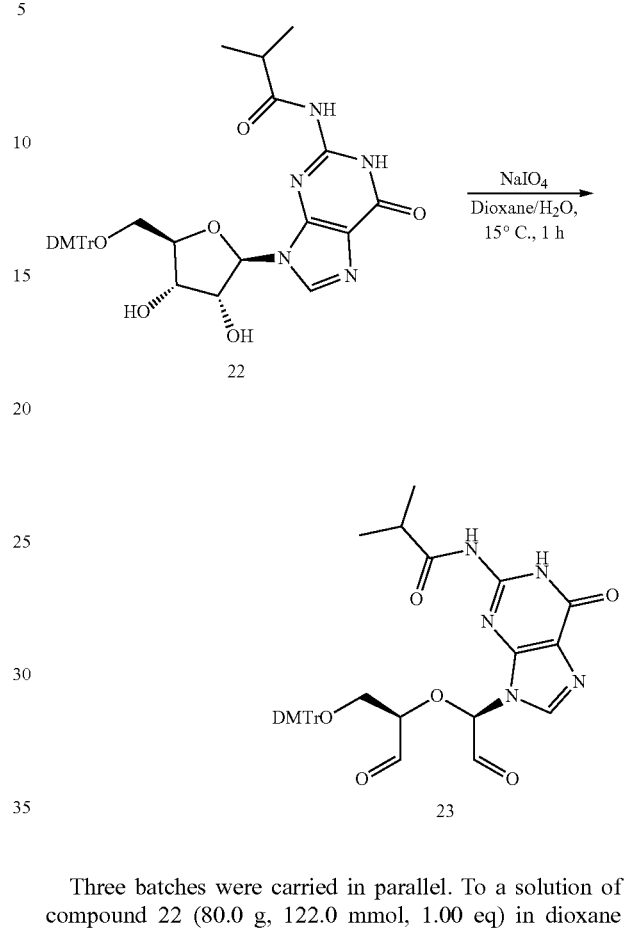

Three batches were carried in parallel. To a solution of compound 22 (80.0 g, 122.0 mmol, 1.00 eq) in dioxane (1600 mL) was added the solution of NaIO$_4$ (26.1 g, 122.0 mmol, 6.76 mL, 1.00 eq) in H$_2$O (640 mL) at 15° C., then stirred at 15° C. for 1 h. TLC (Dichloromethane:Methanol=15:1, $R_f$=0.28) showed no starting material. The reaction mixture was filtered and the filtrate was used for next directly. Afforded compound 23 (239.3 g, crude) as yellow oil. The crude was used for next directly.

Example 29. General Procedure for Preparation of Compound 24

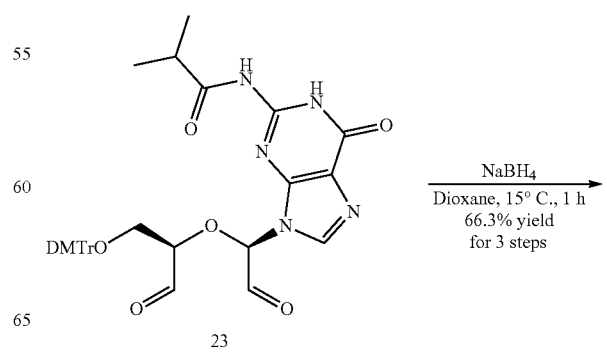

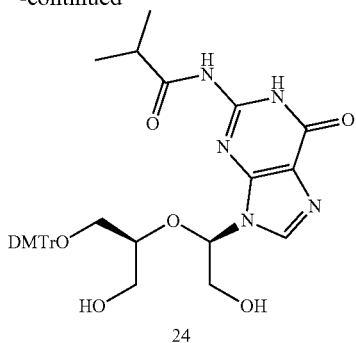

24

To a solution of compound 23 (79.8 g, 122.0 mmol, 1.00 eq) in dioxane (1400 mL) was added NaBH₄ (4.62 g, 122.0 mmol, 1.00 eq) at 15° C., then stirred at 15° C. for 1 h. TLC (Dichloromethane:Methanol=15:1, $R_f$=0.29) showed no starting material. The reaction mixture was added AcOH/Py (1/1, 40 mL), then concentrated in vacuum. The three batches were combined for working up and purification. The residue was extracted with EtOAc (1000 mL×2), washed with aq·NaHCO₃ (600 mL) and brine (600 mL), dried with anhydrous Na₂SO₄, filtered and concentrated in vacuum. The residue was purified by column chromatography (SiO₂, DCM:MeOH=50:1 to 10:1, 1% TEA). Afforded compound 24 (206.0 g, 66.3% yield for 3 steps) as yellow solid.

¹H NMR: (400 MHz, DMSO-d₆) δ 12.11 (s, 1H), 11.71 (s, 1H), 8.17 (s, 1H), 7.21-7.19 (m, 2H), 7.10-7.01 (m, 3H), 6.98-6.96 (m, 4H), 6.80-6.77 (m, 4H), 5.71 (t, J=6.4 Hz, 1H), 5.21 (t, J=5.6 Hz, 1H), 4.78 (t, J=5.2 Hz, 1H), 3.98-3.97 (m, 2H), 3.97-3.76 (m, 1H), 3.71 (s, 6H), 3.44-3.42 (m, 2H), 2.86-2.75 (m, 3H), 1.12-1.06 (m, 6H).

Example 30. General Procedure for Preparation of Compound 25

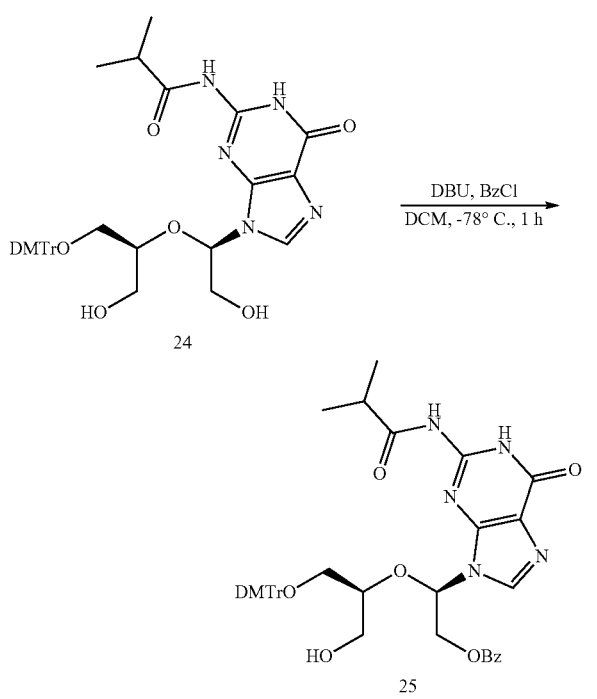

To a solution of compound 24 (93.0 g, 141.4 mmol, 1.00 eq) in DCM (1860 mL) was added DBU (43.1 g, 282.8 mmol, 42.6 mL, 2.00 eq), then cooled to −78° C. and added BzCl (21.9 g, 155.5 mmol, 18.1 mL, 1.10 eq) dropwise at −78° C., then stirred at −78° C. for 1 h. TLC (Dichloromethane:Methanol=15:1, $R_f$=0.38) showed no starting material. The reaction mixture was added EtOH (200 mL) at −78° C., then allowed to 25° C., washed with aq·NaHCO₃ (600 mL×2) and brine (600 mL), dried over anhydrous Na₂SO₄, filtered and concentrated in vacuo. Afforded compound 25 (224.0 g, crude) as yellow solid. The crude was used for next directly.

Example 31. General Procedure for Preparation of Compound 26

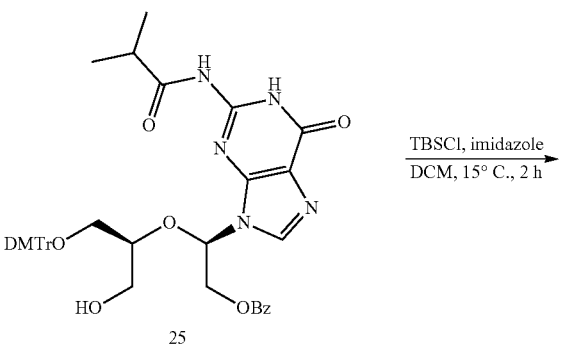

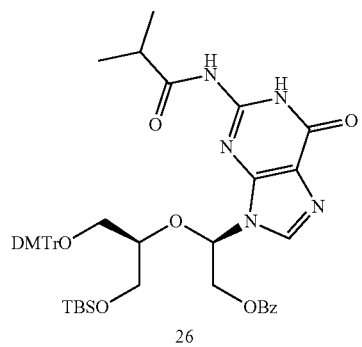

26

To a solution of compound 25 (240.0 g, 315.0 mmol, 1.00 eq) in DCM (1440 mL) was added imidazole (32.2 g, 472.6 mmol, 1.50 eq) and TBSCl (61.7 g, 409.6 mmol, 50.2 mL, 1.30 eq), then stirred at 15° C. for 2 h. TLC (Dichloromethane:Methanol=20:1, $R_f$=0.38) showed no starting material. The reaction mixture was washed with aq·NaHCO₃ (400 mL×2) and brine (400 mL×2), dried with anhydrous Na₂SO₄, filtered and concentrated in vacuum. Afforded compound 26 (263.0 g, crude) as yellow solid. The crude was used for next directly.

Example 31. General Procedure for Preparation of Compound 27

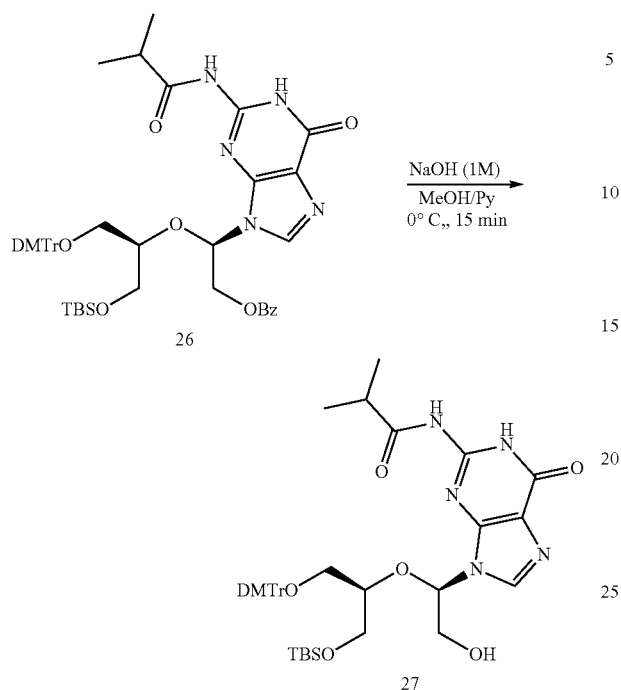

To a solution of compound of 26 (240.0 g, 274 mmol, 1.00 eq) in Py (1200 mL) and MeOH (480 mL) was added NaOH (I M, 313 mL, 1.14 eq) dropwise at 0° C., then stirred at 0° C. for 15 min. TLC (Dichloromethane:Methanol=20: 1, $R_f$=0.21) showed no starting material. The reaction mixture was extracted with EtOAc (1000 mL×2), washed with aq·NH$_4$Cl (1000 mL×2) and brine (1000 mL), dried with anhydrous Na$_2$SO$_4$, filtered and concentrated in vacuum. The residue was purified by column chromatography (SiO$_2$, Petroleum ether/Ethyl acetate=10/1 to DCM:MeOH=20:1, 1% TEA). Afforded compound 27 (50 g, 21.6% yield) as white solid.

$^1$H NMR: (400 MHz, DMSO-d$_6$) δ 12.09 (br s, 1H), 11.64 (br s, 1H), 8.20 (s, 1H), 7.21-7.10 (m, 2H), 7.10-7.01 (m, 3H), 6.99-6.95 (m, 4H), 6.80-6.76 (m, 4H), 5.64 (t, J=6.4 Hz, 1H), 5.16 (t, J=6.0 Hz, 1H), 4.07-4.05 (m, 1H), 3.93-3.92 (m, 1H), 3.71-3.51 (m, 8H), 2.85-2.82 (m, 1H), 2.80-2.50 (m, 3H), 1.10 (t, J=6.0 Hz, 6H), 0.74 (s, 9H), −0.06 (d, J=13.6 Hz, 6H).

Example 32. General Procedure for Preparation of Compound 28

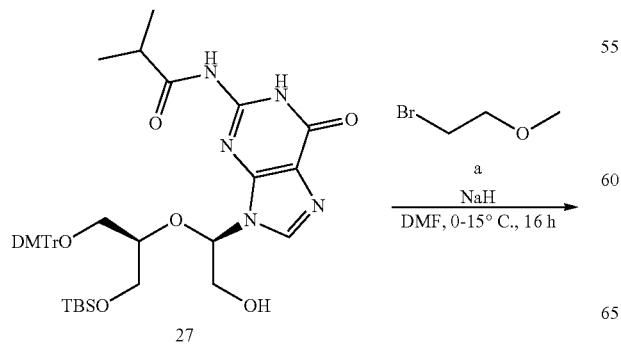

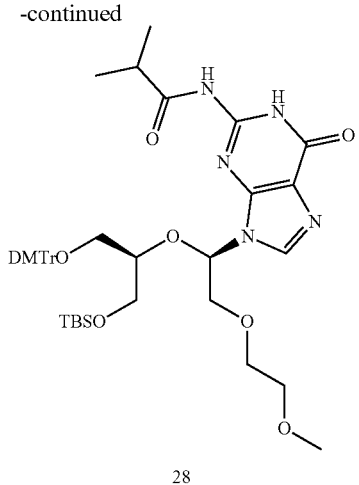

To a solution of NaH (7.52 g, 188.1 mmol, 60% purity, 3.30 eq) in DMF (132 mL) was added the solution of compound 27 (44.0 g, 57.0 mmol, 1.00 eq) in DMF (132 mL) dropwise at 0° C., then stirred at 0° C. for 1 h. The mixture was added compound a (11.9 g, 85.5 mmol, 8.03 mL, 1.50 eq) dropwise at 0° C., and then stirred at 15° C. for 15 h. TLC (Dichloromethane: Methanol=10: 1, $R_f$=0.34) showed no starting material. The reaction mixture was poured into aq·NH$_4$Cl (1500 mL), extracted with EtOAc (500 mL×2), washed with brine (500 mL), dried with anhydrous Na$_2$SO$_4$, filtered and concentrated in vacuum. Afforded compound 28 (47.3 g, crude) as yellow oil. The crude was used for next directly.

Example 33. General Procedure for Preparation of Compound 29

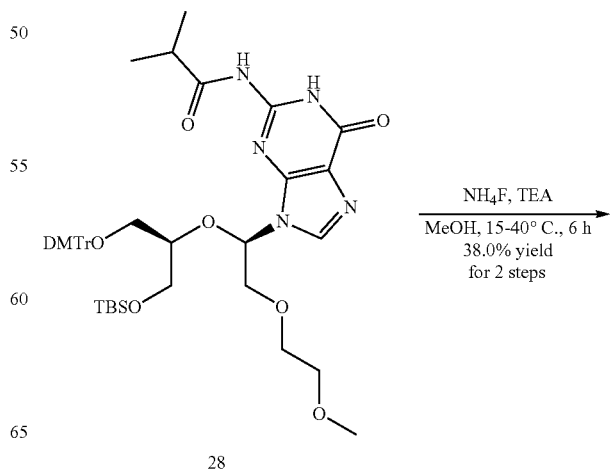

-continued

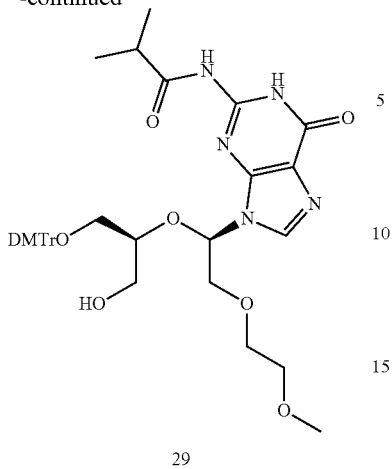

29

To a solution of compound 28 (47.3 g, 57.0 mmol, 1.00 eq) in MeOH (280 mL) was added NH$_4$F (16.9 g, 456.0 mmol, 8.00 eq) and TEA (8.00 g, 79.1 mmol, 11.00 mL, 1.39 eq) at 15° C., then stirred at 40° C. for 6 h. TLC (Dichloromethane:Methanol=10:1, R$_f$=0.33) showed no starting material. The reaction mixture was concentrated in vacuum. The residue was purified by column chromatography (SiO$_2$, DCM:MeOH=100:1 to 10:1, 1% TEA). Afforded compound 29 (15.5 g, 21.6 mmol, 38.0% yield) as white solid.

$^1$H NMR: (400 MHz, DMSO-d$_6$) δ 12.11 (s, 1H), 11.73 (s, 1H), 8.24-8.23 (m, 1H), 7.22-7.01 (m, 5H), 6.99-6.96 (m, 4H), 6.80-6.77 (m, 4H), 5.91-5.85 (m, 1H), 4.79 (t, J=2.6 Hz, 1H), 4.13-4.04 (m, 1H), 4.02-4.00 (m, 2H), 3.73-3.71 (m, 7H), 3.57-3.56 (m, 2H), 3.45-3.43 (m, 2H), 3.38-3.37 (m, 2H), 3.17 (s, 3H), 2.81-2.77 (m, 3H), 1.14-1.10 (m, 6H).

Example 34. General Procedure for Preparation of G-UNA-2'MOE 3'Phosphoramidite

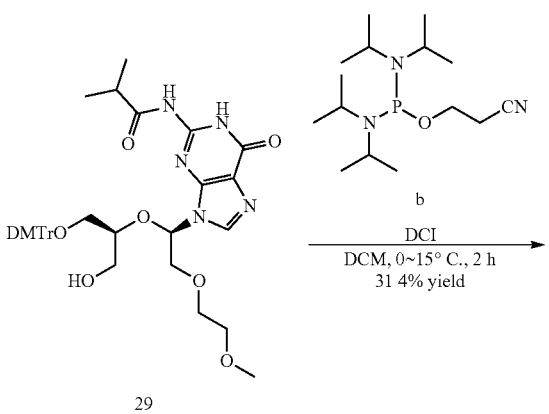

-continued

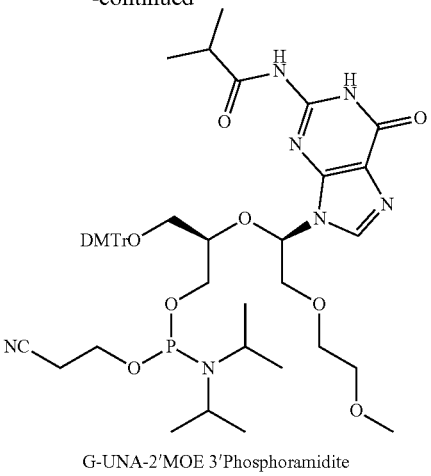

G-UNA-2'MOE 3'Phosphoramidite

To a solution of compound 29 (15.0 g, 21.0 mmol, 1.00 eq) in DCM (90 mL) was added DCI (3.71 g, 31.4 mmol, 1.50 eq) and compound b (10.7 g, 35.6 mmol, 11.31 mL, 1.70 eq) at 0° C., then stirred at 15° C. for 2 h. TLC (Dichloromethane:Acetone=2:1, R$_f$=0.53) showed no starting material. The solution was poured into the silica gel column directly. The reaction mixture was purified by column chromatography (SiO$_2$, Petroleum ether/Ethyl acetate=5/1 to 0/1, 1% TEA). ET32432-31-P1A was combined with ET32432-34-PIA for analysis and delivery. Afforded G-UNA-2'MOE 3'Phosphoramidite (6.5 g, 31.4% yield) as yellow solid.

$^1$H NMR: (400 MHz, DMSO-d$_6$) δ 12.09 (s, 1H), 11.66 (s, 1H), 8.22 (s, 1H), 7.21-6.99 (m, 5H), 6.99-6.98 (m, 4H), 6.80-6.76 (m, 4H), 5.83 (t, J=6.0 Hz, 1H), 4.16-4.15 (m, 1H), 3.89-3.71 (m, 1H), 3.66-3.65 (m, 1H), 3.58-3.56 (m, 12H), 3.39-3.38 (m, 2H), 3.37-3.17 (m, 2H), 3.17 (s, 3H), 2.82-2.72 (m, 3H), 2.72-2.70 (m, 2H), 1.12-1.09 (m, 12H), 1.02-0.99 (m, 6H).

$^{31}$PNMR: (162 MHz, DMSO-d$_6$) δ 147.46

HPLC: 95.8% purity

MS: M−1=914.2

Example 35. Exemplary MSTN siRNA Guide Strands and Passenger Strands Comprising UNA Sense strand and antisense strand sequences targeting MSTN mRNA were generated to include one or more UNAs and/or one or more modified internucleotide linkages. siRNAs comprising the UNA-modified sense strand and/or antisense strands were tested for its stability (Tm) and the efficacy of the siRNA in two different doses (InM and 0.1 nM, respectively). The sequences and test results are shown in Tables 5 and 6.

TABLE 5

| SEQ ID NO | GS (guide, antisense) | SEQ ID NO | PS (passenger, sense) | Tm | 1 nM (% mRNA) | 0.1 nM (% mRNA) |
|---|---|---|---|---|---|---|
| 14239 | vpUqsUfsauuAfuuuguucUfuUfgc csusu | 14240 | gsgscaaaGfAfAfcaaauaau sasa | 64.57 | 21.8 | 50.4 |
| 14241 | vpUqsUfsauuAfuuuguucUfuUfgc csusu | 14242 | GqGqcaaaGfAfAfcaaauaau AqAq | 55.4 | 17.3 | 37.3 |

TABLE 5-continued

| SEQ ID NO | GS (guide, antisense) | SEQ ID NO | PS (passenger, sense) | Tm | 1 nM (% mRNA) | 0.1 nM (% mRNA) |
|---|---|---|---|---|---|---|
| 14243 | vpUqsUfsauuAfuuuguucUfuUfgccsusu | 14244 | GqsGqcaaaGfAfAfcaaauaauAqsAq | 54.56 | 19.9 | 45.9 |
| 14245 | vpUqsUfsauuAfuuuguucUfuUfgccsusu | 14246 | gsgscaaaGfAfAfcaaauaauAqAq | 66.05 | 20.6 | 45.6 |
| 14247 | vpUqsUfsauuAfuuuguucUfuUfgccsusu | 14248 | GqGqcaaaGfAfAfcaaauaausasa | 57.64 | 21.6 | 43.1 |
| 14249 | vpUqsUfsauuAfuuuguucUfuUfgccsusu | 14250 | GqGqCqaaaGfAfAfcaaauaaUqaqaq | 46.72 | 21.5 | 52.4 |
| 14251 | vpUqsUfsauuAfuuuguucUfuUfgccsusu | 14252 | GqGqCqAbaaGfAfAfcaaauaAbUqAqAq | 51.31 | 18.7 | 39.5 |
| 14253 | vpUqsUfsauuAfuuuguucUfuUfgccsusu | 14254 | GbGbcaaaGfAfAfcaaauaauAqAq | 74.06 | 16.1 | 35.6 |
| 14255 | vpUqsUfsauuAfuuuguucUfuUfgccsusu | 14256 | GqGqcaaaGfAfAfcaaauaauAbAb | 62.59 | 15.8 | 34.9 | vp: vinylphosphate
s: phosphorothioate internucleotide linkage
Xf = 2'-fluoro nucleoside
lower case: 2'-O-methyl
Xb: LNA

TABLE 6

| SEQ ID NO | GS (guide, antisense) | SEQ ID NO | PS (passenger, sense) | Tm | 1 nM (% mRNA) | 0.1 nM (% mRNA) |
|---|---|---|---|---|---|---|
| 14257 | vpUqsUfsauuAfuuuguucUfuUfgccsusu | 14258 | gsgscaaaGfAfAfcaaauaausasa | 66.4 | 24.6 | 45.4 |
| 14259 | vpUqsUfsauuAfuuuguucUfuUfgccUqUq | 14260 | gsgscaaaGfAfAfcaaauaausasa | 66.6 | 20.6 | 40.6 |
| 14261 | vpUqsUfsauuAfuuuguucUfuUfGqCqCqsusu | 14262 | gsgscaaaGfAfAfcaaauaausasa | 51.5 | 37.3 | 72.1 |
| 14263 | vpUqsUfsauuAfuuuguucUfuUfGqCqCqTbTb | 14264 | gsgscaaaGfAfAfcaaauaausasa | 51.5 | 29.4 | 61.5 |
| 14265 | vpUqsUfsauuAfuuuguucUfuUfGbCbCbUqUq | 14266 | gsgscaaaGfAfAfcaaauaausasa | 68.26 | 49.7 | 83.7 |
| 14267 | vpUqsUfsauuAfuuuguucUfuUfGqCqCqUqUq | 14268 | gsgscaaaGfAfAfcaaauaausasa | 52.6 | 31.7 | 68.9 |
| 14269 | vpUqsUfsauuAfuuuguucUfuUfgccUqsUq | 14270 | gsgscaaaGfAfAfcaaauaausasa | 66.25 | 16.0 | 34.8 |
| 14271 | vpUqsUfsauuAfuuuguucUfuUfgccsUqsUq | 14272 | gsgscaaaGfAfAfcaaauaausasa | 66.35 | 18.9 | 41.3 |
| 14273 | vpUqsUfsauuAfuuuguucUfuUfgccsUwsUw | 14274 | gsgscaaaGfAfAfcaaauaausasa | 64.5 | 24.9 | 47.8 |
| 14275 | vpUqsUfsauuAfuuuguucUfuUfgccsUxsUx | 14276 | gsgscaaaGfAfAfcaaauaausasa | 65.4 | 21.9 | 43.7 |
| 14277 | vpUqsUfsauuAfuuuguucUfuUfgccsUysUy | 14278 | gsgscaaaGfAfAfcaaauaausasa | 64.97 | 22.5 | 37.5 |
| 14279 | vpUqsUfsauuAfuuuguucUfuUfgccUwUw | 14280 | gsgscaaaGfAfAfcaaauaausasa | 66.55 | 21.0 | 36.6 |
| 14281 | vpUqsUfsauuAfuuuguucUfuUfgccUxUx | 14282 | gsgscaaaGfAfAfcaaauaausasa | 64.8 | 15.9 | 36.0 |
| 14283 | vpUqsUfsauuAfuuuguucUfuUfgccUyUy | 14284 | gsgscaaaGfAfAfcaaauaausasa | 66.37 | 18.8 | 38.1 |

TABLE 6-continued

| SEQ ID NO | GS (guide, antisense) | SEQ ID NO | PS (passenger, sense) | Tm | 1 nM (% mRNA) | 0.1 nM (% mRNA) |
|---|---|---|---|---|---|---|
| 14285 | vpUqsTbauuAfuuuguucUfuUfgccUqsUq | 14286 | gsgscaaaGfAfAfcaaauaausasa | 68.36 | 10.7 | 34.0 |
| 14287 | vpUqsTbauuAfuuuguucUfuUfgccUwsUw | 14288 | gsgscaaaGfAfAfcaaauaausasa | 66.66 | 14.0 | 37.2 |
| 14289 | vpUqsTbauuAfuuuguucUfuUfgccUxsUx | 14290 | gsgscaaaGfAfAfcaaauaausasa | 67.85 | 13.5 | 34.0 |
| 14291 | vpUqsTbauuAfuuuguucUfuUfgccUysUy | 14292 | gsgscaaaGfAfAfcaaauaausasa | 68.46 | 20.6 | 43.7 |
| 14293 | vpUqsUqsauuAfuuuguucUfuUfgccsusu | 14294 | gsgscaaaGfAfAfcaaauaausasa | 65.92 | 89.8 | 103.6 |
| 14295 | vpUqsUfsauuAquuuguucUfuUfgccsusu | 14296 | gsgscaaaGfAfAfcaaauaausasa | 58.34 | 63.1 | 88.8 |
| 14297 | vpUqsUfsauuAfuuuguucUquUfgccsusu | 14298 | gsgscaaaGfAfAfcaaauaausasa | 57.26 | 47.4 | 88.4 |
| 14299 | vpUqsUfsauuAfuuuguucUfuUqgccsusu | 14300 | gsgscaaaGfAfAfcaaauaausasa | 57.45 | 19.5 | 48.2 |
| 14301 | vpUqsUwsauuAfuuuguucUfuUfgccsusu | 14302 | gsgscaaaGfAfAfcaaauaausasa | 65.7 | 93.3 | 85.7 |
| 14303 | vpUqsUfsauuAfuuuguucUwuUfgccsusu | 14304 | gsgscaaaGfAfAfcaaauaausasa |  | 101.6 | 106.5 |
| 14305 | vpUqsUfsauuAfuuuguucUfuUwgccsusu | 14306 | gsgscaaaGfAfAfcaaauaausasa | 57.4 | 24.2 | 48.4 |
| 14307 | vpUqsUxsauuAfuuuguucUfuUfgccsusu | 14308 | gsgscaaaGfAfAfcaaauaausasa | 69.7 | 103.4 | 113.4 |
| 14309 | vpUqsUfsauuAfuuuguucUxuUfgccsusu | 14310 | gsgscaaaGfAfAfcaaauaausasa | 55.31 | 60.2 | 83.3 |
| 14311 | vpUqsUfsauuAfuuuguucUfuUxgccsusu | 14312 | gsgscaaaGfAfAfcaaauaausasa | 56.85 | 21.9 | 47.1 |
| 14313 | vpUqsUysauuAfuuuguucUfuUfgccsusu | 14314 | gsgscaaaGfAfAfcaaauaausasa | 68.7 | 94.8 | 104.2 |
| 14315 | vpUqsUfsauuAfuuuguucUyuUfgccsusu | 14316 | gsgscaaaGfAfAfcaaauaausasa | 56.5 | 66.3 | 92.8 |
| 14317 | vpUqsUfsauuAfuuuguucUfuUygccsusu | 14318 | gsgscaaaGfAfAfcaaauaausasa | 57.39 | 20.7 | 46.0 |
| 14319 | vpUqsTbsAquuAfuuuguucUfuUfgccsusu | 14320 | gsgscaaaGfAfAfcaaauaausasa | 61.6 | 69.8 | 94.0 |
| 14321 | vpUqsUfsauuAbUquuguucUfuUfgccsusu | 14322 | gsgscaaaGfAfAfcaaauaausasa | 61.74 | 64.6 | 93.9 |
| 14323 | vpUqsUfsauuAfUquuguucUfuUfgccsusu | 14324 | gsgscaaaGfAfAfcaaauaausasa | 51 | 56.2 | 82.6 |
| 14325 | vpUqsUfsauuAfuuuguucUfuTbGqccsusu | 14326 | gsgscaaaGfAfAfcaaauaausasa | 59.42 | 24.9 | 57.5 |
| 14327 | vpUqsUfsauuAfuuuguucUfUqTbGqccsusu | 14328 | gsgscaaaGfAfAfcaaauaausasa | 50 | 80.5 | 93.5 |
| 14329 | vpUqsTbsAqUqUqAbuuuguucUfuUfgccsusu | 14330 | gsgscaaaGfAfAfcaaauaausasa | 66.5 | 108.2 | 98.6 |
| 14331 | vpUqsTbsAquUqAbUquuguucUfuUfgccsusu | 14332 | gsgscaaaGfAfAfcaaauaausasa | 58.99 | 102.0 | 102.8 |
| 14333 | vpUqsTbsauuAbUquuguucUfuUfgccsusu | 14334 | gsgscaaaGfAfAfcaaauaausasa | 62.16 | 83.2 | 95.7 |
| 14335 | vpUqsUfsauuAfuuuguucTbuTbGqCqCqsusu | 14336 | gsgscaaaGfAfAfcaaauaausasa | 55.17 | 54.1 | 77.4 |

TABLE 6-continued

| SEQ ID NO | GS (guide, antisense) | SEQ ID NO | PS (passenger, sense) | Tm | 1 nM (% mRNA) | 0.1 nM (% mRNA) |
|---|---|---|---|---|---|---|
| 14337 | vpUqsUfsauuAfuuuguuCqTbUqTbGqccsusu | 14338 | gsgscaaaGfAfAfcaaauaausasa | 37 | 82.2 | 97.0 |
| 14339 | vpUqsUfsauuAquuuguucUfuUqgccsusu | 14340 | gsgscaaaGfAfAfcaaauaausasa | 44.7 | 74.8 | 99.9 |
| 14341 | vpUqsTbsauuAquuuguucTbuUqgccsusu | 14342 | gsgscaaaGfAfAfcaaauaausasa | 49.9 | 89.8 | 89.3 |
| 14343 | vpUqsTbauuAquuuguucTbuUqgcusu | 14344 | gsgscaaaGfAfAfcaaauaausasa | 52.8 | 90.6 | 96.1 | vp: vinylphosphate
s: phosphorothioate internucleotide linkage
Xf = 2'-fluoro nucleoside
lower case: 2'-O-methyl
Xb: LNA

Figure 3:
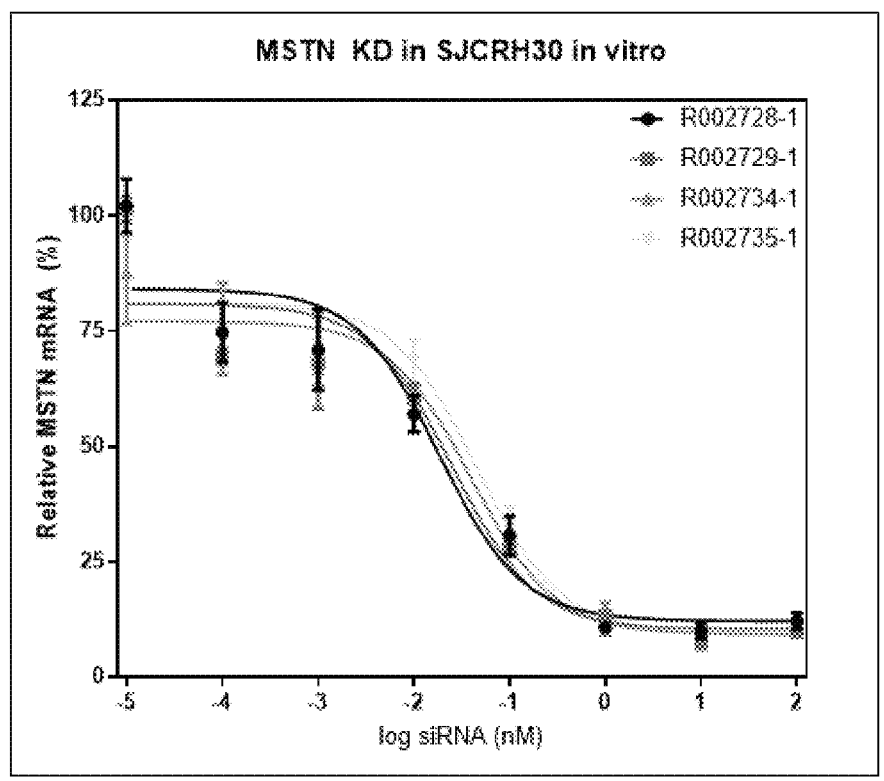
FIG. 3 shows a graph of MSTN knockdown in SJCRH30 cells in vitro using four different types of UNA siRNAs.

Example 36. MSTN siRNA Guide Strands and Passenger Strands Comprising UNA and their Efficacies in Downregulating MSTN mRNA In Vitro Four candidate siRNAs targeting MSTN mRNA were tested for its efficacy to downregulate MSTN mRNA in vitro in SJCRH30 cells. The sequences of four candidate siRNAs (R002728-1, R002729-1, R002734-1, R002735-1) and their stability (indicated by Tm) and efficacy (EC50 value) are shown in Table 7. FIG. 3 also shows downregulation of MSTN mRNA in SJCRH30 cells by each candidate siRNA.

TABLE 7

| siRNA | SEQ ID NO | PS (passenger, sense) | SEQ ID NO | GS (guide, antisense) | EC50 (pM) | Tm [C.] |
|---|---|---|---|---|---|---|
| R002728-1 | 14345 | aminoC6-gsgscaaaGfAfAfcaaauaausasa | 14346 | vpUqsUfsauuAfuuuguucUfuUfgccUqUq | 18.41 | 67.51 |
| R002729-1 | 14347 | aminoC6-gsgscaaaGfAfAfcaaauaausasa | 14348 | vpUqsUfsauuAfuuuguucUfuUfgccUqsUq | 25.27 | 67.5 |
| R002734-1 | 14349 | aminoC6-GqGqcaaaGfAfAfcaaauaauAqAq | 14350 | vpUqsUfsauuAfuuuguucUfuUfgccsusu | 39.45 | 54 |
| R002735-1 | 14351 | aminoC6-GqsGqcaaaGfAfAfcaaauaauAqsAq | 14352 | vpUqsUfsauuAfuuuguucUfuUfgccsusu | 45.19 | 54.8 | vp: vinylphosphate
s: phosphorothioate internucleotide linkage
Xf = 2'-fluoro nucleoside
lower case: 2'-O-methyl
Xb: LNA

Figure 4:
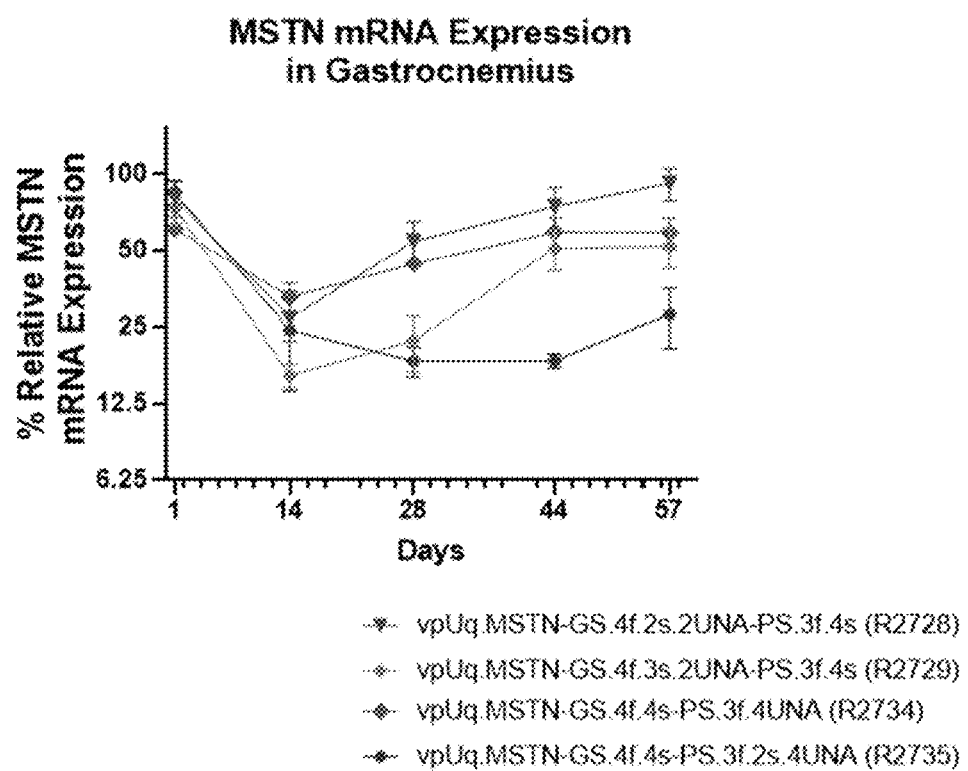
FIG. 4 shows a graph of MSTN knockdown in Gastrocnemius tissue in vivo using α-CD71-UNA siRNA conjugates.

Example 37. MSTN siRNA Guide Strands and Passenger Strands Comprising UNA and their Efficacy in Downregulating MSTN mRNA In Vivo Four siRNAs targeting MSTN mRNA were tested for its efficacy to downregulate MSTN mRNA in vivo. The sequences of four candidate siRNAs (R002728-1, R002729-1, R002734-1, R002735-1) and their stability (indicated by Tm) and efficacy (EC50 value) are shown in Table 7. siRNA targeting MSTN mRNA was conjugated with a-CD71 antibody, and the a-CD71-MSTN siRNA were administered in vivo to determine the effect of the a-CD71-MSTN siRNA. Table 8 shows Kd (% mRNA) value and the concentration of siRNAs in the Gastronecmius muscle after administering the siRNA conjugates. FIG. 4 shows a comparison graph of the four MSTN siRNA conjugates.

TABLE 8

| siRNA | KD in Gastroc [% mRNA] | | | | siRNA in Gastroc [nM] | | | |
|---|---|---|---|---|---|---|---|---|
| | d14 | d28 | d44 | d57 | d14 | d28 | d44 | d57 |
| R002728-1 | 27 | 54 | 75 | 92 | | | | |
| R002729-1 | 16 | 22 | 51 | 52 | 19.8 | 8.0 | 3.4 | 2.2 |
| R002734-1 | 33 | 44 | 59 | 59 | 8.0 | 2.4 | 0.9 | 0.3 |
| R002735-1 | 24 | 18 | 18 | 28 | 14.0 | 5.1 | 2.4 | 0.6 |

While preferred embodiments of the present disclosure have been shown and described herein, it will be obvious to those skilled in the art that such embodiments are provided by way of example only. Numerous variations, changes, and substitutions will now occur to those skilled in the art without departing from the disclosure. It should be understood that various alternatives to the embodiments of the disclosure described herein may be employed in practicing the disclosure. It is intended that the following claims define the scope of the disclosure and that methods and structures within the scope of these claims and their equivalents be covered thereby.

SEQUENCE LISTING (14352 sequences)

SEQ ID NO: 1 - protein, 24 aa, Artificial Sequence
  Description of Artificial Sequence: Synthetic peptide
CGIFGEIEELIEEGLENLIDWGNA

SEQ ID NO: 2 - protein, 24 aa, Artificial Sequence
  Description of Artificial Sequence: Synthetic peptide
GLFEAIEGFIENGWEGMIDGWYGC

SEQ ID NO: 3 - protein, 27 aa, Artificial Sequence
  Description of Artificial Sequence: Synthetic peptide
GLFEAIEGFIENGWEGMIWDYGSGSCG

SEQ ID NO: 4 - protein, 23 aa, Artificial Sequence
  Description of Artificial Sequence: Synthetic peptide
GLFEAIEGFIENGWEGMIDGWYG

SEQ ID NO: 5 - protein, 27 aa, Artificial Sequence
  Description of Artificial Sequence: Synthetic peptide
GLFEAIEGFIENGWEGMIWDYGSGSCK

SEQ ID NO: 6 - protein, 27 aa, Artificial Sequence
  Description of Artificial Sequence: Synthetic peptide
CLIGAILKVLATGLPTLISWIKNKRKQ

SEQ ID NO: 7 - protein, 26 aa, Artificial Sequence
  Description of Artificial Sequence: Synthetic peptide
GIGAVLKVLTTGLPALISWIKRKRQQ

SEQ ID NO: 8 - protein, 13 aa, Artificial Sequence
  Description of Artificial Sequence: Synthetic peptide
IFGAIAGLLKNIF

SEQ ID NO: 9 - protein, 18 aa, Artificial Sequence
  Description of Artificial Sequence: Synthetic peptide
FFGHLFKLATKIIPSLFQ

SEQ ID NO: 10 - protein, 21 aa, Artificial Sequence
  Description of Artificial Sequence: Synthetic peptide
KETWWETWWTEWSQPKKKRKV

SEQ ID NO: 11 - protein, 19 aa, Artificial Sequence
  Description of Artificial Sequence: Synthetic peptide
LLIILRRRRIRKQAHAHSK

SEQ ID NO: 12 - protein, 26 aa, Artificial Sequence
  Description of Artificial Sequence: Synthetic peptide
DPKGDPKGVTVTVTVTVTGKGDPKPD

SEQ ID NO: 13 - protein, 17 aa, Artificial Sequence
  Description of Artificial Sequence: Synthetic peptide
CSIPPEVKFNKPFVYLI

SEQ ID NO: 14 - protein, 27 aa, Artificial Sequence
  Description of Artificial Sequence: Synthetic peptide
GWTLNSAGYLLGKINLKALAALAKKIL

SEQ ID NO: 15 - protein, 21 aa, Artificial Sequence
  Description of Artificial Sequence: Synthetic peptide
AGYLLGKINLKALAALAKKIL

SEQ ID NO: 16 - protein, 17 aa, Artificial Sequence
  Description of Artificial Sequence: Synthetic peptide
GALFLGFLGAAGSTMGA

SEQ ID NO: 17 - protein, 20 aa, Artificial Sequence
  Description of Artificial Sequence: Synthetic peptide
HGLASTLTRWAHYNALIRAF

SEQ ID NO: 18 - protein, 20 aa, Artificial Sequence
  Description of Artificial Sequence: Synthetic peptide
GLWRALWRLLRSLWRLLWRA

SEQ ID NO: 19 - protein, 30 aa, Artificial Sequence
  Description of Artificial Sequence: Synthetic polypeptide
WEAALAEALAEALAEHLAEALAEALEALAA

SEQ ID NO: 20 - protein, 24 aa, Artificial Sequence
  Description of Artificial Sequence: Synthetic peptide
GLFEAIEGFIENGWEGMIDGWYGC

SEQ ID NO: 21 - protein, 23 aa, Artificial Sequence
  Description of Artificial Sequence: Synthetic peptide
GLFGAIAGFIENGWEGMIDGWYG

SEQ ID NO: 22 - protein, 36 aa, Artificial Sequence
  Description of Artificial Sequence: Synthetic polypeptide
GLFGAIAGFIENGWEGMIDGRQIKIWFQNRRMKWKK

SEQ ID NO: 23 - protein, 26 aa, Artificial Sequence
  Description of Artificial Sequence: Synthetic peptide
GLFGAIAGFIENGWEGMIDGSSKKKK

SEQ ID NO: 24 - protein, 24 aa, Artificial Sequence
  Description of Artificial Sequence: Synthetic peptide
GLFEAIAGFIENGWEGMIDGGGYC

SEQ ID NO: 25 - protein, 23 aa, Artificial Sequence
  Description of Artificial Sequence: Synthetic peptide
GLFHAIAHFIHGGWHGLIHGWYG

SEQ ID NO: 26 - protein, 30 aa, Artificial Sequence
  Description of Artificial Sequence: Synthetic polypeptide
GLFEAIEGFIENGWEGLAEALAEALEALAA

SEQ ID NO: 27 - protein, 29 aa, Artificial Sequence
  Description of Artificial Sequence: Synthetic peptide
KWKLFKKIGAVLKVLTTGYGRKKRRQRRR

SEQ ID NO: 28 - RNA, 23 nt, Mus musculus
gggcagcggcccgggauaaauac

SEQ ID NO: 29 - RNA, 23 nt, Mus musculus
ggcagcggcccgggauaaauacu

SEQ ID NO: 30 - RNA, 23 nt, Mus musculus
aaccaaaacucaguacuuccauc

SEQ ID NO: 31 - RNA, 23 nt, Mus musculus
uacgaaggagcgccauggauacu

SEQ ID NO: 32 - RNA, 23 nt, Mus musculus
gcuuucaacagacuggacuucuc

SEQ ID NO: 33 - RNA, 23 nt, Mus musculus
cagaagauucaacuacguaguaa

SEQ ID NO: 34 - RNA, 23 nt, Mus musculus
gaguggcaucgcccaaaagaacu

SEQ ID NO: 35 - RNA, 23 nt, Mus musculus
aagacuuauacgggaacuucucc

SEQ ID NO: 36 - RNA, 23 nt, Mus musculus
aagcuuguacgauguuacccaag

SEQ ID NO: 37 - RNA, 23 nt, Mus musculus
agcuuguacgauguuacccaaga

SEQ ID NO: 38 - RNA, 23 nt, Mus musculus
uggaagggcacugaccauccgug

SEQ ID NO: 39 - RNA, 23 nt, Mus musculus
gaagggcacugaccauccgugca

SEQ ID NO: 40 - RNA, 23 nt, Mus musculus
agggcacugaccauccgugcacg

SEQ ID NO: 41 - RNA, 23 nt, Mus musculus
aagacuuuaucaauuuguucaag

SEQ ID NO: 42 - RNA, 23 nt, Mus musculus
gggagucgggacacuucauuugu

SEQ ID NO: 43 - RNA, 23 nt, Mus musculus
cgggggauacgucauugaggaga

SEQ ID NO: 44 - RNA, 23 nt, Mus musculus
uugccgauggaaauuuacaaaug

SEQ ID NO: 45 - RNA, 23 nt, Mus musculus
ccacacaauggucuaccucuaaa

SEQ ID NO: 46 - RNA, 23 nt, Mus musculus
acaauggucuaccucuaaaagca

SEQ ID NO: 47 - RNA, 23 nt, Mus musculus
cugauagauguguucgucuuaaa

SEQ ID NO: 48 - RNA, 23 nt, Mus musculus
aucucagggcuuaaggaguuaau

SEQ ID NO: 49 - RNA, 23 nt, Mus musculus
cucagggcuuaaggaguuaauuc

SEQ ID NO: 50 - RNA, 23 nt, Mus musculus
cugauuugcagggucuuacaucu

SEQ ID NO: 51 - RNA, 23 nt, Mus musculus
cugguggccaaauuaaguugaau

SEQ ID NO: 52 - RNA, 23 nt, Mus musculus
ugguggccaaauuaaguugaauu

SEQ ID NO: 53 - RNA, 23 nt, Mus musculus
gagauuacaaacauuguaacaga

SEQ ID NO: 54 - RNA, 23 nt, Mus musculus
cagcgcaaaacuaguuagccagu

SEQ ID NO: 55 - RNA, 23 nt, Mus musculus
aacuaguuagccagucuuacaga

SEQ ID NO: 56 - RNA, 23 nt, Mus musculus
aagucauauagcauccauacacc

SEQ ID NO: 57 - RNA, 23 nt, Mus musculus
uaguaggugcuugcagguucucc

SEQ ID NO: 58 - RNA, 23 nt, Mus musculus
augguaugugacacaaccgaaga

SEQ ID NO: 59 - RNA, 23 nt, Mus musculus
cacaaccgaagaaucguuugacg

SEQ ID NO: 60 - RNA, 23 nt, Mus musculus
ggcaagcaagauacccauauuag

SEQ ID NO: 61 - RNA, 23 nt, Mus musculus
agcucuuaggacauuaauagucu

SEQ ID NO: 62 - RNA, 23 nt, Mus musculus
ugcaggacucccagacuuaaaac

SEQ ID NO: 63 - RNA, 23 nt, Mus musculus
cccagaacugcuaguacaaaagc

SEQ ID NO: 64 - RNA, 23 nt, Mus musculus
agcaagagggguguggcuauaga

SEQ ID NO: 65 - RNA, 23 nt, Mus musculus
gagggguguggcuauagaaguug

SEQ ID NO: 66 - RNA, 23 nt, Mus musculus
gaccaugucgcuacuaccauugc

SEQ ID NO: 67 - RNA, 23 nt, Mus musculus
gucgcuacuaccauugcuucaag

SEQ ID NO: 68 - RNA, 23 nt, Mus musculus
accauugcuucaaguggguaucu

SEQ ID NO: 69 - RNA, 23 nt, Mus musculus
uugcuucaaguggguaucucagu

SEQ ID NO: 70 - RNA, 23 nt, Mus musculus
cugguuagugaugaucaacuuca

SEQ ID NO: 71 - RNA, 23 nt, Mus musculus
ugccgcuucauacgggagaaaaa

SEQ ID NO: 72 - RNA, 23 nt, Mus musculus
ucggcuucaacgcauuguuuauu

SEQ ID NO: 73 - RNA, 23 nt, Mus musculus
cugccugguuauaaagcaauaac

SEQ ID NO: 74 - RNA, 23 nt, Mus musculus
accuguuagugcuuaaacagacu

SEQ ID NO: 75 - RNA, 23 nt, Mus musculus
cuguuagugcuuaaacagacuca

SEQ ID NO: 76 - RNA, 23 nt, Mus musculus
ggggcaaacgcagggguguuacu

SEQ ID NO: 77 - RNA, 23 nt, Mus musculus
ggguguuacucuuugauauauca

SEQ ID NO: 78 - RNA, 23 nt, Mus musculus
aucccagacuuuagaccaaaagg

SEQ ID NO: 79 - RNA, 23 nt, Mus musculus
uuguggacguguguaaauucaug

SEQ ID NO: 80 - RNA, 23 nt, Mus musculus
uucauugaccaaccagucuuaag

SEQ ID NO: 81 - RNA, 23 nt, Mus musculus
ugccgcaaccucccaagucauau

SEQ ID NO: 82 - RNA, 23 nt, Mus musculus
gaguauagacaugcguguuaacu

SEQ ID NO: 83 - RNA, 23 nt, Mus musculus
gacaugcguguuaacuaugcaca

SEQ ID NO: 84 - RNA, 23 nt, Mus musculus
uugguuccaucuuuauaccaaau

SEQ ID NO: 85 - RNA, 23 nt, Mus musculus
gugucuaagcuuagaagcuuuaa

SEQ ID NO: 86 - RNA, 23 nt, Mus musculus
uggguugaacacuuuaacuaaac

SEQ ID NO: 87 - RNA, 23 nt, Mus musculus
aucugaauccuguauaacuuauu

SEQ ID NO: 88 - RNA, 23 nt, Mus musculus
cugaauccuguauaacuuauuug

SEQ ID NO: 89 - RNA, 23 nt, Mus musculus
auccuguauaacuuauuugcaca

SEQ ID NO: 90 - RNA, 23 nt, Homo sapiens
uuccagaagauuuaacuacgugg

SEQ ID NO: 91 - RNA, 23 nt, Homo sapiens
cagaagauuuaacuacguggucc

SEQ ID NO: 92 - RNA, 23 nt, Homo sapiens
agcggcagauccgcaaacgauua

SEQ ID NO: 93 - RNA, 23 nt, Homo sapiens
ggcagauccgcaaacgauuaauu

SEQ ID NO: 94 - RNA, 23 nt, Homo sapiens
cagauccgcaaacgauuaauucu

SEQ ID NO: 95 - RNA, 23 nt, Homo sapiens
gauccgcaaacgauuaauucugu

SEQ ID NO: 96 - RNA, 23 nt, Homo sapiens
auccgcaaacgauuaauucuguc

SEQ ID NO: 97 - RNA, 23 nt, Homo sapiens
uccgcaaacgauuaauucuguca

SEQ ID NO: 98 - RNA, 23 nt, Homo sapiens
cgcaaacgauuaauucugucaga

SEQ ID NO: 99 - RNA, 23 nt, Homo sapiens
aacgauuaauucugucagacaaa

SEQ ID NO: 100 - RNA, 23 nt, Homo sapiens
auguauuucaaacuuguccgaug

SEQ ID NO: 101 - RNA, 23 nt, Homo sapiens
guccgauguuacccaaggaaaga

SEQ ID NO: 102 - RNA, 23 nt, Homo sapiens
agcaguauggagauacccuucag

SEQ ID NO: 103 - RNA, 23 nt, Homo sapiens
ccauccgugcacugccaauaacc

SEQ ID NO: 104 - RNA, 23 nt, Homo sapiens
agagcugcuccguuucacuuuca

SEQ ID NO: 105 - RNA, 23 nt, Homo sapiens
ugggaauauggcauuuggacacu

SEQ ID NO: 106 - RNA, 23 nt, Homo sapiens
ugugaacuucucacuagaauugg

SEQ ID NO: 107 - RNA, 23 nt, Homo sapiens
ucucacuagaauugguauggaaa

SEQ ID NO: 108 - RNA, 23 nt, Homo sapiens
cagcaagacuauaagggcaauaa

SEQ ID NO: 109 - RNA, 23 nt, Homo sapiens
caagacuauaagggcaauaauuc

SEQ ID NO: 110 - RNA, 23 nt, Homo sapiens
ucuuauaguucccuaggaagaaa

SEQ ID NO: 111 - RNA, 23 nt, Homo sapiens
auaggacgcuuuguuuacaaugu

SEQ ID NO: 112 - RNA, 23 nt, Homo sapiens
uuuucuuuagguccaacaucaaa

SEQ ID NO: 113 - RNA, 23 nt, Homo sapiens
uuucuuuagguccaacaucaaaa

SEQ ID NO: 114 - RNA, 23 nt, Homo sapiens
aggagagguaccacaaguucauc

SEQ ID NO: 115 - RNA, 23 nt, Homo sapiens
gaggcaaauaucagcagguaacu

SEQ ID NO: 116 - RNA, 23 nt, Homo sapiens
ggcaaauaucagcagguaacugu

SEQ ID NO: 117 - RNA, 23 nt, Homo sapiens
uuuccuacaacaauguacauaua

SEQ ID NO: 118 - RNA, 23 nt, Homo sapiens
aagagacaagcuaugauacaaca

SEQ ID NO: 119 - RNA, 23 nt, Homo sapiens
gaaaucaaccuuuaugguucucu

SEQ ID NO: 120 - RNA, 23 nt, Homo sapiens
gugccacgugguaucuguuaagu

SEQ ID NO: 121 - RNA, 23 nt, Homo sapiens
ccacgugguaucuguuaaguaug

SEQ ID NO: 122 - RNA, 23 nt, Homo sapiens
auggccagagccucacauauaag

SEQ ID NO: 123 - RNA, 23 nt, Homo sapiens
gccagagccucacauauaaguga

SEQ ID NO: 124 - RNA, 23 nt, Homo sapiens
agagccucacauauaagugaaga

SEQ ID NO: 125 - RNA, 23 nt, Homo sapiens
auaauagucuauagaauuucuau

SEQ ID NO: 126 - RNA, 23 nt, Homo sapiens
gccuagagucucuugagaguaaa

SEQ ID NO: 127 - RNA, 23 nt, Homo sapiens
gaaagcauccccaauguaucagu

SEQ ID NO: 128 - RNA, 23 nt, Homo sapiens
aauguaucaguugugagaugauu

SEQ ID NO: 129 - RNA, 23 nt, Homo sapiens
cuacuagcacuugggcaguaagg

SEQ ID NO: 130 - RNA, 23 nt, Homo sapiens
uuaacuaaacucuaucaucauuu

SEQ ID NO: 131 - RNA, 23 nt, Homo sapiens
cuggccuaaaauccuauuagugc

SEQ ID NO: 132 - RNA, 23 nt, Homo sapiens
aauccuauuagugcuuaaacaga

SEQ ID NO: 133 - RNA, 23 nt, Homo sapiens
uccuauuagugcuuaaacagacc

SEQ ID NO: 134 - RNA, 23 nt, Homo sapiens
uuugauauaucuuggguccuuga

SEQ ID NO: 135 - RNA, 23 nt, Homo sapiens
uggcuguuaacguuuccauuuca

SEQ ID NO: 136 - RNA, 23 nt, Homo sapiens
gcuguuaacguuuccauuucaag

SEQ ID NO: 137 - RNA, 23 nt, Homo sapiens
cucagagguacauuuaauccauc

SEQ ID NO: 138 - RNA, 23 nt, Homo sapiens
caggaccagcuaugagauucagu

SEQ ID NO: 139 - RNA, 23 nt, Homo sapiens
gggggauuauuccaugaggcagc

SEQ ID NO: 140 - RNA, 23 nt, Homo sapiens
ggcuccaagcuguauucuauacu

SEQ ID NO: 141 - RNA, 23 nt, Homo sapiens
uuuguaccagacgguggcauauu

SEQ ID NO: 142 - RNA, 19 nt, Artificial Sequence
  Description of Artificial Sequence: Synthetic oligonucleotide
gcagcggcccgggauaaau

SEQ ID NO: 143 - RNA, 19 nt, Artificial Sequence
  Description of Artificial Sequence: Synthetic oligonucleotide
cagcggcccgggauaaaua

SEQ ID NO: 144 - RNA, 19 nt, Artificial Sequence
  Description of Artificial Sequence: Synthetic oligonucleotide
ccaaaacucaguacuucca

SEQ ID NO: 145 - RNA, 19 nt, Artificial Sequence
  Description of Artificial Sequence: Synthetic oligonucleotide
cgaaggagcgccauggaua

SEQ ID NO: 146 - RNA, 19 nt, Artificial Sequence
  Description of Artificial Sequence: Synthetic oligonucleotide
uuucaacagacuggacuuc

SEQ ID NO: 147 - RNA, 19 nt, Artificial Sequence
  Description of Artificial Sequence: Synthetic oligonucleotide
gaagauucaacuacguagu

SEQ ID NO: 148 - RNA, 19 nt, Artificial Sequence
  Description of Artificial Sequence: Synthetic oligonucleotide
guggcaucgcccaaaagaa

SEQ ID NO: 149 - RNA, 19 nt, Artificial Sequence
  Description of Artificial Sequence: Synthetic oligonucleotide
gacuuauacgggaacuucu

SEQ ID NO: 150 - RNA, 19 nt, Artificial Sequence
  Description of Artificial Sequence: Synthetic oligonucleotide
gcuuguacgauguuaccca

SEQ ID NO: 151 - RNA, 19 nt, Artificial Sequence
  Description of Artificial Sequence: Synthetic oligonucleotide
cuuguacgauguuacccaa

SEQ ID NO: 152 - RNA, 19 nt, Artificial Sequence
  Description of Artificial Sequence: Synthetic oligonucleotide
gaagggcacugaccauccg

SEQ ID NO: 153 - RNA, 19 nt, Artificial Sequence
  Description of Artificial Sequence: Synthetic oligonucleotide
agggcacugaccauccgug

SEQ ID NO: 154 - RNA, 19 nt, Artificial Sequence
  Description of Artificial Sequence: Synthetic oligonucleotide
ggcacugaccauccgugca

SEQ ID NO: 155 - RNA, 19 nt, Artificial Sequence
  Description of Artificial Sequence: Synthetic oligonucleotide
gacuuuaucaauuuguuca

SEQ ID NO: 156 - RNA, 19 nt, Artificial Sequence
  Description of Artificial Sequence: Synthetic oligonucleotide
gagucgggacacuucauuu

SEQ ID NO: 157 - RNA, 19 nt, Artificial Sequence
  Description of Artificial Sequence: Synthetic oligonucleotide
ggggauacgucauugagga

SEQ ID NO: 158 - RNA, 19 nt, Artificial Sequence
  Description of Artificial Sequence: Synthetic oligonucleotide
gccgauggaaauuuacaaa

SEQ ID NO: 159 - RNA, 19 nt, Artificial Sequence
  Description of Artificial Sequence: Synthetic oligonucleotide
acacaauggucuaccucua

SEQ ID NO: 160 - RNA, 19 nt, Artificial Sequence
  Description of Artificial Sequence: Synthetic oligonucleotide
aauggucuaccucuaaaag

SEQ ID NO: 161 - RNA, 19 nt, Artificial Sequence
  Description of Artificial Sequence: Synthetic oligonucleotide
gauagauguguucgucuua

SEQ ID NO: 162 - RNA, 19 nt, Artificial Sequence
  Description of Artificial Sequence: Synthetic oligonucleotide
cucagggcuuaaggaguua

SEQ ID NO: 163 - RNA, 19 nt, Artificial Sequence
  Description of Artificial Sequence: Synthetic oligonucleotide
cagggcuuaaggaguuaau

SEQ ID NO: 164 - RNA, 19 nt, Artificial Sequence
  Description of Artificial Sequence: Synthetic oligonucleotide
gauuugcagggucuuacau

SEQ ID NO: 165 - RNA, 19 nt, Artificial Sequence
  Description of Artificial Sequence: Synthetic oligonucleotide
gguggccaaauuaaguuga

SEQ ID NO: 166 - RNA, 19 nt, Artificial Sequence
  Description of Artificial Sequence: Synthetic oligonucleotide
guggccaaauuaaguugaa

SEQ ID NO: 167 - RNA, 19 nt, Artificial Sequence
  Description of Artificial Sequence: Synthetic oligonucleotide
gauuacaaacauuguaaca

SEQ ID NO: 168 - RNA, 19 nt, Artificial Sequence
  Description of Artificial Sequence: Synthetic oligonucleotide
gcgcaaaacuaguuagcca

SEQ ID NO: 169 - RNA, 19 nt, Artificial Sequence
  Description of Artificial Sequence: Synthetic oligonucleotide
cuaguuagccagucuuaca

SEQ ID NO: 170 - RNA, 19 nt, Artificial Sequence
  Description of Artificial Sequence: Synthetic oligonucleotide
gucauauagcauccauaca

SEQ ID NO: 171 - RNA, 19 nt, Artificial Sequence
  Description of Artificial Sequence: Synthetic oligonucleotide
guaggugcuugcagguucu

SEQ ID NO: 172 - RNA, 19 nt, Artificial Sequence
  Description of Artificial Sequence: Synthetic oligonucleotide
gguaugugacacaaccgaa

SEQ ID NO: 173 - RNA, 19 nt, Artificial Sequence
  Description of Artificial Sequence: Synthetic oligonucleotide
caaccgaagaaucguuuga

SEQ ID NO: 174 - RNA, 19 nt, Artificial Sequence
  Description of Artificial Sequence: Synthetic oligonucleotide
caagcaagauacccauauu

SEQ ID NO: 175 - RNA, 19 nt, Artificial Sequence
  Description of Artificial Sequence: Synthetic oligonucleotide
cucuuaggacauuaauagu

SEQ ID NO: 176 - RNA, 19 nt, Artificial Sequence
  Description of Artificial Sequence: Synthetic oligonucleotide
caggacucccagacuuaaa

SEQ ID NO: 177 - RNA, 19 nt, Artificial Sequence
  Description of Artificial Sequence: Synthetic oligonucleotide
cagaacugcuaguacaaaa

SEQ ID NO: 178 - RNA, 19 nt, Artificial Sequence
  Description of Artificial Sequence: Synthetic oligonucleotide
caagagggguguggcuaua

SEQ ID NO: 179 - RNA, 19 nt, Artificial Sequence
  Description of Artificial Sequence: Synthetic oligonucleotide
gggguguggcuauagaagu

SEQ ID NO: 180 - RNA, 19 nt, Artificial Sequence
  Description of Artificial Sequence: Synthetic oligonucleotide
ccaugucgcuacuaccauu

SEQ ID NO: 181 - RNA, 19 nt, Artificial Sequence
  Description of Artificial Sequence: Synthetic oligonucleotide
cgcuacuaccauugcuuca

SEQ ID NO: 182 - RNA, 19 nt, Artificial Sequence
  Description of Artificial Sequence: Synthetic oligonucleotide
cauugcuucaaguggguau

SEQ ID NO: 183 - RNA, 19 nt, Artificial Sequence
  Description of Artificial Sequence: Synthetic oligonucleotide
gcuucaaguggguaucuca

SEQ ID NO: 184 - RNA, 19 nt, Artificial Sequence
  Description of Artificial Sequence: Synthetic oligonucleotide
gguuagugaugaucaacuu

SEQ ID NO: 185 - RNA, 19 nt, Artificial Sequence
  Description of Artificial Sequence: Synthetic oligonucleotide
ccgcuucauacgggagaaa

SEQ ID NO: 186 - RNA, 19 nt, Artificial Sequence
  Description of Artificial Sequence: Synthetic oligonucleotide
ggcuucaacgcauuguuua

SEQ ID NO: 187 - RNA, 19 nt, Artificial Sequence
  Description of Artificial Sequence: Synthetic oligonucleotide
gccugguuauaaagcaaua

SEQ ID NO: 188 - RNA, 19 nt, Artificial Sequence
  Description of Artificial Sequence: Synthetic oligonucleotide
cuguuagugcuuaaacaga

SEQ ID NO: 189 - RNA, 19 nt, Artificial Sequence
  Description of Artificial Sequence: Synthetic oligonucleotide
guuagugcuuaaacagacu

SEQ ID NO: 190 - RNA, 19 nt, Artificial Sequence
  Description of Artificial Sequence: Synthetic oligonucleotide
ggcaaacgcagggguguua

SEQ ID NO: 191 - RNA, 19 nt, Artificial Sequence
  Description of Artificial Sequence: Synthetic oligonucleotide
guguuacucuuugauauau

SEQ ID NO: 192 - RNA, 19 nt, Artificial Sequence
  Description of Artificial Sequence: Synthetic oligonucleotide
cccagacuuuagaccaaaa

SEQ ID NO: 193 - RNA, 19 nt, Artificial Sequence
  Description of Artificial Sequence: Synthetic oligonucleotide
guggacguguguaaauuca

SEQ ID NO: 194 - RNA, 19 nt, Artificial Sequence
  Description of Artificial Sequence: Synthetic oligonucleotide
cauugaccaaccagucuua

SEQ ID NO: 195 - RNA, 19 nt, Artificial Sequence
  Description of Artificial Sequence: Synthetic oligonucleotide
ccgcaaccucccaagucau

SEQ ID NO: 196 - RNA, 19 nt, Artificial Sequence
  Description of Artificial Sequence: Synthetic oligonucleotide
guauagacaugcguguuaa

SEQ ID NO: 197 - RNA, 19 nt, Artificial Sequence
  Description of Artificial Sequence: Synthetic oligonucleotide
caugcguguuaacuaugca

SEQ ID NO: 198 - RNA, 19 nt, Artificial Sequence
  Description of Artificial Sequence: Synthetic oligonucleotide
gguuccaucuuuauaccaa

SEQ ID NO: 199 - RNA, 19 nt, Artificial Sequence
  Description of Artificial Sequence: Synthetic oligonucleotide
gucuaagcuuagaagcuuu

SEQ ID NO: 200 - RNA, 19 nt, Artificial Sequence
  Description of Artificial Sequence: Synthetic oligonucleotide
gguugaacacuuuaacuaa

SEQ ID NO: 201 - RNA, 19 nt, Artificial Sequence
  Description of Artificial Sequence: Synthetic oligonucleotide
cugaauccuguauaacuua

SEQ ID NO: 202 - RNA, 19 nt, Artificial Sequence
  Description of Artificial Sequence: Synthetic oligonucleotide
gaauccuguauaacuuauu

SEQ ID NO: 203 - RNA, 19 nt, Artificial Sequence
  Description of Artificial Sequence: Synthetic oligonucleotide
ccuguauaacuuauuugca

SEQ ID NO: 204 - RNA, 19 nt, Artificial Sequence
  Description of Artificial Sequence: Synthetic oligonucleotide
ccagaagauuuaacuacgu

SEQ ID NO: 205 - RNA, 19 nt, Artificial Sequence
  Description of Artificial Sequence: Synthetic oligonucleotide
gaagauuuaacuacguggu

SEQ ID NO: 206 - RNA, 19 nt, Artificial Sequence
  Description of Artificial Sequence: Synthetic oligonucleotide
cggcagauccgcaaacgau

SEQ ID NO: 207 - RNA, 19 nt, Artificial Sequence
  Description of Artificial Sequence: Synthetic oligonucleotide
cagauccgcaaacgauuaa

SEQ ID NO: 208 - RNA, 19 nt, Artificial Sequence
  Description of Artificial Sequence: Synthetic oligonucleotide
gauccgcaaacgauuaauu

SEQ ID NO: 209 - RNA, 19 nt, Artificial Sequence
  Description of Artificial Sequence: Synthetic oligonucleotide
uccgcaaacgauuaauucu

SEQ ID NO: 210 - RNA, 19 nt, Artificial Sequence
  Description of Artificial Sequence: Synthetic oligonucleotide
ccgcaaacgauuaauucug

SEQ ID NO: 211 - RNA, 19 nt, Artificial Sequence
  Description of Artificial Sequence: Synthetic oligonucleotide
cgcaaacgauuaauucugu

SEQ ID NO: 212 - RNA, 19 nt, Artificial Sequence
  Description of Artificial Sequence: Synthetic oligonucleotide
caaacgauuaauucuguca

SEQ ID NO: 213 - RNA, 19 nt, Artificial Sequence
  Description of Artificial Sequence: Synthetic oligonucleotide
cgauuaauucugucagaca

SEQ ID NO: 214 - RNA, 19 nt, Artificial Sequence
  Description of Artificial Sequence: Synthetic oligonucleotide
guauuucaaacuuguccga

SEQ ID NO: 215 - RNA, 19 nt, Artificial Sequence
  Description of Artificial Sequence: Synthetic oligonucleotide
ccgauguuacccaaggaaa

SEQ ID NO: 216 - RNA, 19 nt, Artificial Sequence
  Description of Artificial Sequence: Synthetic oligonucleotide
caguauggagauacccuuc

SEQ ID NO: 217 - RNA, 19 nt, Artificial Sequence
  Description of Artificial Sequence: Synthetic oligonucleotide
auccgugcacugccaauaa

SEQ ID NO: 218 - RNA, 19 nt, Artificial Sequence
  Description of Artificial Sequence: Synthetic oligonucleotide
agcugcuccguuucacuuu

SEQ ID NO: 219 - RNA, 19 nt, Artificial Sequence
  Description of Artificial Sequence: Synthetic oligonucleotide
ggaauauggcauuuggaca

SEQ ID NO: 220 - RNA, 19 nt, Artificial Sequence
  Description of Artificial Sequence: Synthetic oligonucleotide
ugaacuucucacuagaauu

SEQ ID NO: 221 - RNA, 19 nt, Artificial Sequence
  Description of Artificial Sequence: Synthetic oligonucleotide
ucacuagaauugguaugga

SEQ ID NO: 222 - RNA, 19 nt, Artificial Sequence
  Description of Artificial Sequence: Synthetic oligonucleotide
gcaagacuauaagggcaau

SEQ ID NO: 223 - RNA, 19 nt, Artificial Sequence
  Description of Artificial Sequence: Synthetic oligonucleotide
agacuauaagggcaauaau

SEQ ID NO: 224 - RNA, 19 nt, Artificial Sequence
  Description of Artificial Sequence: Synthetic oligonucleotide
uuauaguucccuaggaaga

SEQ ID NO: 225 - RNA, 19 nt, Artificial Sequence
  Description of Artificial Sequence: Synthetic oligonucleotide
aggacgcuuuguuuacaau

SEQ ID NO: 226 - RNA, 19 nt, Artificial Sequence
  Description of Artificial Sequence: Synthetic oligonucleotide
uucuuuagguccaacauca

SEQ ID NO: 227 - RNA, 19 nt, Artificial Sequence
  Description of Artificial Sequence: Synthetic oligonucleotide
ucuuuagguccaacaucaa

SEQ ID NO: 228 - RNA, 19 nt, Artificial Sequence
  Description of Artificial Sequence: Synthetic oligonucleotide
gagagguaccacaaguuca

SEQ ID NO: 229 - RNA, 19 nt, Artificial Sequence
  Description of Artificial Sequence: Synthetic oligonucleotide
ggcaaauaucagcagguaa

SEQ ID NO: 230 - RNA, 19 nt, Artificial Sequence
  Description of Artificial Sequence: Synthetic oligonucleotide
caaauaucagcagguaacu

SEQ ID NO: 231 - RNA, 19 nt, Artificial Sequence
  Description of Artificial Sequence: Synthetic oligonucleotide
uccuacaacaauguacaua

SEQ ID NO: 232 - RNA, 19 nt, Artificial Sequence
  Description of Artificial Sequence: Synthetic oligonucleotide
gagacaagcuaugauacaa

SEQ ID NO: 233 - RNA, 19 nt, Artificial Sequence
  Description of Artificial Sequence: Synthetic oligonucleotide
aaucaaccuuuaugguucu

SEQ ID NO: 234 - RNA, 19 nt, Artificial Sequence
  Description of Artificial Sequence: Synthetic oligonucleotide
gccacgugguaucuguuaa

SEQ ID NO: 235 - RNA, 19 nt, Artificial Sequence
  Description of Artificial Sequence: Synthetic oligonucleotide
acgugguaucuguuaagua

SEQ ID NO: 236 - RNA, 19 nt, Artificial Sequence
  Description of Artificial Sequence: Synthetic oligonucleotide
ggccagagccucacauaua

SEQ ID NO: 237 - RNA, 19 nt, Artificial Sequence
  Description of Artificial Sequence: Synthetic oligonucleotide
cagagccucacauauaagu

SEQ ID NO: 238 - RNA, 19 nt, Artificial Sequence
  Description of Artificial Sequence: Synthetic oligonucleotide
agccucacauauaagugaa

SEQ ID NO: 239 - RNA, 19 nt, Artificial Sequence
  Description of Artificial Sequence: Synthetic oligonucleotide
aauagucuauagaauuucu

SEQ ID NO: 240 - RNA, 19 nt, Artificial Sequence
  Description of Artificial Sequence: Synthetic oligonucleotide
cuagagucucuugagagua

SEQ ID NO: 241 - RNA, 19 nt, Artificial Sequence
  Description of Artificial Sequence: Synthetic oligonucleotide
aagcauccccaauguauca

SEQ ID NO: 242 - RNA, 19 nt, Artificial Sequence
  Description of Artificial Sequence: Synthetic oligonucleotide
uguaucaguugugagauga

SEQ ID NO: 243 - RNA, 19 nt, Artificial Sequence
  Description of Artificial Sequence: Synthetic oligonucleotide
acuagcacuugggcaguaa

SEQ ID NO: 244 - RNA, 19 nt, Artificial Sequence
  Description of Artificial Sequence: Synthetic oligonucleotide
aacuaaacucuaucaucau

SEQ ID NO: 245 - RNA, 19 nt, Artificial Sequence
  Description of Artificial Sequence: Synthetic oligonucleotide
ggccuaaaauccuauuagu

SEQ ID NO: 246 - RNA, 19 nt, Artificial Sequence
  Description of Artificial Sequence: Synthetic oligonucleotide
uccuauuagugcuuaaaca

SEQ ID NO: 247 - RNA, 19 nt, Artificial Sequence
  Description of Artificial Sequence: Synthetic oligonucleotide
cuauuagugcuuaaacaga

SEQ ID NO: 248 - RNA, 19 nt, Artificial Sequence
  Description of Artificial Sequence: Synthetic oligonucleotide
ugauauaucuuggguccuu

SEQ ID NO: 249 - RNA, 19 nt, Artificial Sequence
  Description of Artificial Sequence: Synthetic oligonucleotide
gcuguuaacguuuccauuu

SEQ ID NO: 250 - RNA, 19 nt, Artificial Sequence
  Description of Artificial Sequence: Synthetic oligonucleotide
uguuaacguuuccauuuca

SEQ ID NO: 251 - RNA, 19 nt, Artificial Sequence
  Description of Artificial Sequence: Synthetic oligonucleotide
cagagguacauuuaaucca

SEQ ID NO: 252 - RNA, 19 nt, Artificial Sequence
  Description of Artificial Sequence: Synthetic oligonucleotide
ggaccagcuaugagauuca

SEQ ID NO: 253 - RNA, 19 nt, Artificial Sequence
  Description of Artificial Sequence: Synthetic oligonucleotide
gggauuauuccaugaggca

SEQ ID NO: 254 - RNA, 19 nt, Artificial Sequence
  Description of Artificial Sequence: Synthetic oligonucleotide
cuccaagcuguauucuaua

SEQ ID NO: 255 - RNA, 19 nt, Artificial Sequence
  Description of Artificial Sequence: Synthetic oligonucleotide
uguaccagacgguggcaua

SEQ ID NO: 256 - RNA, 19 nt, Artificial Sequence
  Description of Artificial Sequence: Synthetic oligonucleotide
auuuaucccgggccgcugc

SEQ ID NO: 257 - RNA, 19 nt, Artificial Sequence
  Description of Artificial Sequence: Synthetic oligonucleotide
uauuuaucccgggccgcug

SEQ ID NO: 258 - RNA, 19 nt, Artificial Sequence
  Description of Artificial Sequence: Synthetic oligonucleotide
uggaaguacugaguuuugg

SEQ ID NO: 259 - RNA, 19 nt, Artificial Sequence
  Description of Artificial Sequence: Synthetic oligonucleotide
uauccauggcgcuccuucg

SEQ ID NO: 260 - RNA, 19 nt, Artificial Sequence
  Description of Artificial Sequence: Synthetic oligonucleotide
gaaguccagucuguugaaa

SEQ ID NO: 261 - RNA, 19 nt, Artificial Sequence
  Description of Artificial Sequence: Synthetic oligonucleotide
acuacguaguugaaucuuc

SEQ ID NO: 262 - RNA, 19 nt, Artificial Sequence
  Description of Artificial Sequence: Synthetic oligonucleotide
uucuuuugggcgaugccac

SEQ ID NO: 263 - RNA, 19 nt, Artificial Sequence
  Description of Artificial Sequence: Synthetic oligonucleotide
agaaguucccguauaaguc

SEQ ID NO: 264 - RNA, 19 nt, Artificial Sequence
  Description of Artificial Sequence: Synthetic oligonucleotide
uggguaacaucguacaagc

SEQ ID NO: 265 - RNA, 19 nt, Artificial Sequence
  Description of Artificial Sequence: Synthetic oligonucleotide
uuggguaacaucguacaag

SEQ ID NO: 266 - RNA, 19 nt, Artificial Sequence
  Description of Artificial Sequence: Synthetic oligonucleotide
cggauggucagugcccuuc

SEQ ID NO: 267 - RNA, 19 nt, Artificial Sequence
  Description of Artificial Sequence: Synthetic oligonucleotide
cacggauggucagugcccu

SEQ ID NO: 268 - RNA, 19 nt, Artificial Sequence
  Description of Artificial Sequence: Synthetic oligonucleotide
ugcacggauggucagugcc

SEQ ID NO: 269 - RNA, 19 nt, Artificial Sequence
  Description of Artificial Sequence: Synthetic oligonucleotide
ugaacaaauugauaaaguc

SEQ ID NO: 270 - RNA, 19 nt, Artificial Sequence
  Description of Artificial Sequence: Synthetic oligonucleotide
aaaugaagugucccgacuc

SEQ ID NO: 271 - RNA, 19 nt, Artificial Sequence
  Description of Artificial Sequence: Synthetic oligonucleotide
uccucaaugacguaucccc

SEQ ID NO: 272 - RNA, 19 nt, Artificial Sequence
  Description of Artificial Sequence: Synthetic oligonucleotide
uuuguaaauuuccaucggc

SEQ ID NO: 273 - RNA, 19 nt, Artificial Sequence
  Description of Artificial Sequence: Synthetic oligonucleotide
uagagguagaccauugugu

SEQ ID NO: 274 - RNA, 19 nt, Artificial Sequence
  Description of Artificial Sequence: Synthetic oligonucleotide
cuuuuagagguagaccauu

SEQ ID NO: 275 - RNA, 19 nt, Artificial Sequence
  Description of Artificial Sequence: Synthetic oligonucleotide
uaagacgaacacaucuauc

SEQ ID NO: 276 - RNA, 19 nt, Artificial Sequence
  Description of Artificial Sequence: Synthetic oligonucleotide
uaacuccuuaagcccugag

SEQ ID NO: 277 - RNA, 19 nt, Artificial Sequence
  Description of Artificial Sequence: Synthetic oligonucleotide
auuaacuccuuaagcccug

SEQ ID NO: 278 - RNA, 19 nt, Artificial Sequence
  Description of Artificial Sequence: Synthetic oligonucleotide
auguaagacccugcaaauc

SEQ ID NO: 279 - RNA, 19 nt, Artificial Sequence
  Description of Artificial Sequence: Synthetic oligonucleotide
ucaacuuaauuuggccacc

SEQ ID NO: 280 - RNA, 19 nt, Artificial Sequence
  Description of Artificial Sequence: Synthetic oligonucleotide
uucaacuuaauuuggccac

SEQ ID NO: 281 - RNA, 19 nt, Artificial Sequence
  Description of Artificial Sequence: Synthetic oligonucleotide
uguuacaauguuuguaauc

SEQ ID NO: 282 - RNA, 19 nt, Artificial Sequence
  Description of Artificial Sequence: Synthetic oligonucleotide
uggcuaacuaguuuugcgc

SEQ ID NO: 283 - RNA, 19 nt, Artificial Sequence
  Description of Artificial Sequence: Synthetic oligonucleotide
uguaagacuggcuaacuag

SEQ ID NO: 284 - RNA, 19 nt, Artificial Sequence
  Description of Artificial Sequence: Synthetic oligonucleotide
uguauggaugcuauaugac

SEQ ID NO: 285 - RNA, 19 nt, Artificial Sequence
  Description of Artificial Sequence: Synthetic oligonucleotide
agaaccugcaagcaccuac

SEQ ID NO: 286 - RNA, 19 nt, Artificial Sequence
  Description of Artificial Sequence: Synthetic oligonucleotide
uucgguugugucacauacc

SEQ ID NO: 287 - RNA, 19 nt, Artificial Sequence
  Description of Artificial Sequence: Synthetic oligonucleotide
ucaaacgauucuucgguug

SEQ ID NO: 288 - RNA, 19 nt, Artificial Sequence
  Description of Artificial Sequence: Synthetic oligonucleotide
aauauggguaucuugcuug

SEQ ID NO: 289 - RNA, 19 nt, Artificial Sequence
  Description of Artificial Sequence: Synthetic oligonucleotide
acuauuaauguccuaagag

SEQ ID NO: 290 - RNA, 19 nt, Artificial Sequence
  Description of Artificial Sequence: Synthetic oligonucleotide
uuuaagucugggaguccug

SEQ ID NO: 291 - RNA, 19 nt, Artificial Sequence
  Description of Artificial Sequence: Synthetic oligonucleotide
uuuuguacuagcaguucug

SEQ ID NO: 292 - RNA, 19 nt, Artificial Sequence
  Description of Artificial Sequence: Synthetic oligonucleotide
uauagccacaccccucuug

SEQ ID NO: 293 - RNA, 19 nt, Artificial Sequence
  Description of Artificial Sequence: Synthetic oligonucleotide
acuucuauagccacacccc

SEQ ID NO: 294 - RNA, 19 nt, Artificial Sequence
  Description of Artificial Sequence: Synthetic oligonucleotide
aaugguaguagcgacaugg

SEQ ID NO: 295 - RNA, 19 nt, Artificial Sequence
  Description of Artificial Sequence: Synthetic oligonucleotide
ugaagcaaugguaguagcg

SEQ ID NO: 296 - RNA, 19 nt, Artificial Sequence
  Description of Artificial Sequence: Synthetic oligonucleotide
auacccacuugaagcaaug

SEQ ID NO: 297 - RNA, 19 nt, Artificial Sequence
  Description of Artificial Sequence: Synthetic oligonucleotide
ugagauacccacuugaagc

SEQ ID NO: 298 - RNA, 19 nt, Artificial Sequence
  Description of Artificial Sequence: Synthetic oligonucleotide
aaguugaucaucacuaacc

SEQ ID NO: 299 - RNA, 19 nt, Artificial Sequence
  Description of Artificial Sequence: Synthetic oligonucleotide
uuucucccguaugaagcgg

SEQ ID NO: 300 - RNA, 19 nt, Artificial Sequence
  Description of Artificial Sequence: Synthetic oligonucleotide
uaaacaaugcguugaagcc

SEQ ID NO: 301 - RNA, 19 nt, Artificial Sequence
  Description of Artificial Sequence: Synthetic oligonucleotide
uauugcuuuauaaccaggc

SEQ ID NO: 302 - RNA, 19 nt, Artificial Sequence
  Description of Artificial Sequence: Synthetic oligonucleotide
ucuguuuaagcacuaacag

SEQ ID NO: 303 - RNA, 19 nt, Artificial Sequence
  Description of Artificial Sequence: Synthetic oligonucleotide
agucuguuuaagcacuaac

SEQ ID NO: 304 - RNA, 19 nt, Artificial Sequence
  Description of Artificial Sequence: Synthetic oligonucleotide
uaacaccccugcguuugcc

SEQ ID NO: 305 - RNA, 19 nt, Artificial Sequence
  Description of Artificial Sequence: Synthetic oligonucleotide
auauaucaaagaguaacac

SEQ ID NO: 306 - RNA, 19 nt, Artificial Sequence
  Description of Artificial Sequence: Synthetic oligonucleotide
uuuuggucuaaagucuggg

SEQ ID NO: 307 - RNA, 19 nt, Artificial Sequence
  Description of Artificial Sequence: Synthetic oligonucleotide
ugaauuuacacacguccac

SEQ ID NO: 308 - RNA, 19 nt, Artificial Sequence
  Description of Artificial Sequence: Synthetic oligonucleotide
uaagacugguuggucaaug

SEQ ID NO: 309 - RNA, 19 nt, Artificial Sequence
  Description of Artificial Sequence: Synthetic oligonucleotide
augacuugggagguugcgg

SEQ ID NO: 310 - RNA, 19 nt, Artificial Sequence
  Description of Artificial Sequence: Synthetic oligonucleotide
uuaacacgcaugucuauac

SEQ ID NO: 311 - RNA, 19 nt, Artificial Sequence
  Description of Artificial Sequence: Synthetic oligonucleotide
ugcauaguuaacacgcaug

SEQ ID NO: 312 - RNA, 19 nt, Artificial Sequence
  Description of Artificial Sequence: Synthetic oligonucleotide
uugguauaaagauggaacc

SEQ ID NO: 313 - RNA, 19 nt, Artificial Sequence
  Description of Artificial Sequence: Synthetic oligonucleotide
aaagcuucuaagcuuagac

SEQ ID NO: 314 - RNA, 19 nt, Artificial Sequence
  Description of Artificial Sequence: Synthetic oligonucleotide
uuaguuaaaguguucaacc

SEQ ID NO: 315 - RNA, 19 nt, Artificial Sequence
  Description of Artificial Sequence: Synthetic oligonucleotide
uaaguuauacaggauucag

SEQ ID NO: 316 - RNA, 19 nt, Artificial Sequence
  Description of Artificial Sequence: Synthetic oligonucleotide
aauaaguuauacaggauuc

SEQ ID NO: 317 - RNA, 19 nt, Artificial Sequence
  Description of Artificial Sequence: Synthetic oligonucleotide
ugcaaauaaguuauacagg

SEQ ID NO: 318 - RNA, 19 nt, Artificial Sequence
  Description of Artificial Sequence: Synthetic oligonucleotide
acguaguuaaaucuucugg

SEQ ID NO: 319 - RNA, 19 nt, Artificial Sequence
  Description of Artificial Sequence: Synthetic oligonucleotide
accacguaguuaaaucuuc

SEQ ID NO: 320 - RNA, 19 nt, Artificial Sequence
  Description of Artificial Sequence: Synthetic oligonucleotide
aucguuugcggaucugccg

SEQ ID NO: 321 - RNA, 19 nt, Artificial Sequence
  Description of Artificial Sequence: Synthetic oligonucleotide
uuaaucguuugcggaucug

SEQ ID NO: 322 - RNA, 19 nt, Artificial Sequence
  Description of Artificial Sequence: Synthetic oligonucleotide
aauuaaucguuugcggauc

SEQ ID NO: 323 - RNA, 19 nt, Artificial Sequence
  Description of Artificial Sequence: Synthetic oligonucleotide
agaauuaaucguuugcgga

SEQ ID NO: 324 - RNA, 19 nt, Artificial Sequence
  Description of Artificial Sequence: Synthetic oligonucleotide
cagaauuaaucguuugcgg

SEQ ID NO: 325 - RNA, 19 nt, Artificial Sequence
  Description of Artificial Sequence: Synthetic oligonucleotide
acagaauuaaucguuugcg

SEQ ID NO: 326 - RNA, 19 nt, Artificial Sequence
  Description of Artificial Sequence: Synthetic oligonucleotide
ugacagaauuaaucguuug

SEQ ID NO: 327 - RNA, 19 nt, Artificial Sequence
  Description of Artificial Sequence: Synthetic oligonucleotide
ugucugacagaauuaaucg

SEQ ID NO: 328 - RNA, 19 nt, Artificial Sequence
  Description of Artificial Sequence: Synthetic oligonucleotide
ucggacaaguuugaaauac

SEQ ID NO: 329 - RNA, 19 nt, Artificial Sequence
  Description of Artificial Sequence: Synthetic oligonucleotide
uuuccuuggguaacaucgg

SEQ ID NO: 330 - RNA, 19 nt, Artificial Sequence
  Description of Artificial Sequence: Synthetic oligonucleotide
gaaggguaucuccauacug

SEQ ID NO: 331 - RNA, 19 nt, Artificial Sequence
  Description of Artificial Sequence: Synthetic oligonucleotide
uuauuggcagugcacggau

SEQ ID NO: 332 - RNA, 19 nt, Artificial Sequence
  Description of Artificial Sequence: Synthetic oligonucleotide
aaagugaaacggagcagcu

SEQ ID NO: 333 - RNA, 19 nt, Artificial Sequence
  Description of Artificial Sequence: Synthetic oligonucleotide
uguccaaaugccauauucc

SEQ ID NO: 334 - RNA, 19 nt, Artificial Sequence
  Description of Artificial Sequence: Synthetic oligonucleotide
aauucuagugagaaguuca

SEQ ID NO: 335 - RNA, 19 nt, Artificial Sequence
  Description of Artificial Sequence: Synthetic oligonucleotide
uccauaccaauucuaguga

SEQ ID NO: 336 - RNA, 19 nt, Artificial Sequence
  Description of Artificial Sequence: Synthetic oligonucleotide
auugcccuuauagucuugc

SEQ ID NO: 337 - RNA, 19 nt, Artificial Sequence
  Description of Artificial Sequence: Synthetic oligonucleotide
auuauugcccuuauagucu

SEQ ID NO: 338 - RNA, 19 nt, Artificial Sequence
  Description of Artificial Sequence: Synthetic oligonucleotide
ucuuccuagggaacuauaa

SEQ ID NO: 339 - RNA, 19 nt, Artificial Sequence
  Description of Artificial Sequence: Synthetic oligonucleotide
auuguaaacaaagcguccu

SEQ ID NO: 340 - RNA, 19 nt, Artificial Sequence
  Description of Artificial Sequence: Synthetic oligonucleotide
ugauguuggaccuaaagaa

SEQ ID NO: 341 - RNA, 19 nt, Artificial Sequence
  Description of Artificial Sequence: Synthetic oligonucleotide
uugauguuggaccuaaaga

SEQ ID NO: 342 - RNA, 19 nt, Artificial Sequence
  Description of Artificial Sequence: Synthetic oligonucleotide
ugaacuugugguaccucuc

SEQ ID NO: 343 - RNA, 19 nt, Artificial Sequence
  Description of Artificial Sequence: Synthetic oligonucleotide
uuaccugcugauauuugcc

SEQ ID NO: 344 - RNA, 19 nt, Artificial Sequence
  Description of Artificial Sequence: Synthetic oligonucleotide
aguuaccugcugauauuug

SEQ ID NO: 345 - RNA, 19 nt, Artificial Sequence
  Description of Artificial Sequence: Synthetic oligonucleotide
uauguacauuguuguagga

SEQ ID NO: 346 - RNA, 19 nt, Artificial Sequence
  Description of Artificial Sequence: Synthetic oligonucleotide
uuguaucauagcuugucuc

SEQ ID NO: 347 - RNA, 19 nt, Artificial Sequence
  Description of Artificial Sequence: Synthetic oligonucleotide
agaaccauaaagguugauu

SEQ ID NO: 348 - RNA, 19 nt, Artificial Sequence
  Description of Artificial Sequence: Synthetic oligonucleotide
uuaacagauaccacguggc

SEQ ID NO: 349 - RNA, 19 nt, Artificial Sequence
  Description of Artificial Sequence: Synthetic oligonucleotide
uacuuaacagauaccacgu

SEQ ID NO: 350 - RNA, 19 nt, Artificial Sequence
  Description of Artificial Sequence: Synthetic oligonucleotide
uauaugugaggcucuggcc

SEQ ID NO: 351 - RNA, 19 nt, Artificial Sequence
  Description of Artificial Sequence: Synthetic oligonucleotide
acuuauaugugaggcucug

SEQ ID NO: 352 - RNA, 19 nt, Artificial Sequence
  Description of Artificial Sequence: Synthetic oligonucleotide
uucacuuauaugugaggcu

SEQ ID NO: 353 - RNA, 19 nt, Artificial Sequence
  Description of Artificial Sequence: Synthetic oligonucleotide
agaaauucuauagacuauu

SEQ ID NO: 354 - RNA, 19 nt, Artificial Sequence
  Description of Artificial Sequence: Synthetic oligonucleotide
uacucucaagagacucuag

SEQ ID NO: 355 - RNA, 19 nt, Artificial Sequence
  Description of Artificial Sequence: Synthetic oligonucleotide
ugauacauuggggaugcuu

SEQ ID NO: 356 - RNA, 19 nt, Artificial Sequence
  Description of Artificial Sequence: Synthetic oligonucleotide
ucaucucacaacugauaca

SEQ ID NO: 357 - RNA, 19 nt, Artificial Sequence
  Description of Artificial Sequence: Synthetic oligonucleotide
uuacugcccaagugcuagu

SEQ ID NO: 358 - RNA, 19 nt, Artificial Sequence
  Description of Artificial Sequence: Synthetic oligonucleotide
augaugauagaguuuaguu

SEQ ID NO: 359 - RNA, 19 nt, Artificial Sequence
  Description of Artificial Sequence: Synthetic oligonucleotide
acuaauaggauuuuaggcc

SEQ ID NO: 360 - RNA, 19 nt, Artificial Sequence
  Description of Artificial Sequence: Synthetic oligonucleotide
uguuuaagcacuaauagga

SEQ ID NO: 361 - RNA, 19 nt, Artificial Sequence
  Description of Artificial Sequence: Synthetic oligonucleotide
ucuguuuaagcacuaauag

SEQ ID NO: 362 - RNA, 19 nt, Artificial Sequence
  Description of Artificial Sequence: Synthetic oligonucleotide
aaggacccaagauauauca

SEQ ID NO: 363 - RNA, 19 nt, Artificial Sequence
  Description of Artificial Sequence: Synthetic oligonucleotide
aaauggaaacguuaacagc

SEQ ID NO: 364 - RNA, 19 nt, Artificial Sequence
  Description of Artificial Sequence: Synthetic oligonucleotide
ugaaauggaaacguuaaca

SEQ ID NO: 365 - RNA, 19 nt, Artificial Sequence
  Description of Artificial Sequence: Synthetic oligonucleotide
uggauuaaauguaccucug

SEQ ID NO: 366 - RNA, 19 nt, Artificial Sequence
  Description of Artificial Sequence: Synthetic oligonucleotide
ugaaucucauagcuggucc

SEQ ID NO: 367 - RNA, 19 nt, Artificial Sequence
  Description of Artificial Sequence: Synthetic oligonucleotide
ugccucauggaauaauccc

SEQ ID NO: 368 - RNA, 19 nt, Artificial Sequence
  Description of Artificial Sequence: Synthetic oligonucleotide
uauagaauacagcuuggag

SEQ ID NO: 369 - RNA, 19 nt, Artificial Sequence
  Description of Artificial Sequence: Synthetic oligonucleotide
uaugccaccgucugguaca

SEQ ID NO: 370 - RNA, 23 nt, Mus musculus
gaggauccgaguggguuuggaga

SEQ ID NO: 371 - RNA, 23 nt, Mus musculus
cgagacagucgcauuucaaagca

SEQ ID NO: 372 - RNA, 23 nt, Mus musculus
ggauuauaaaucuagccugauuc

SEQ ID NO: 373 - RNA, 23 nt, Mus musculus
uccugauggaaacgcuauggaga

SEQ ID NO: 374 - RNA, 23 nt, Mus musculus
aggcugcgaaucccuacuggacc

SEQ ID NO: 375 - RNA, 23 nt, Mus musculus
gucguuuccguugccccucgugc

SEQ ID NO: 376 - RNA, 23 nt, Mus musculus
uugccccucgugccgccaugaag

SEQ ID NO: 377 - RNA, 23 nt, Mus musculus
ugccccucgugccgccaugaagu

SEQ ID NO: 378 - RNA, 23 nt, Mus musculus
gccccucgugccgccaugaagug

SEQ ID NO: 379 - RNA, 23 nt, Mus musculus
gugccgccaugaagugaucaugg

SEQ ID NO: 380 - RNA, 23 nt, Mus musculus
ugaagugaucauggaccggcacg

SEQ ID NO: 381 - RNA, 23 nt, Mus musculus
agcaggagugcuccagucggccc

SEQ ID NO: 382 - RNA, 23 nt, Mus musculus
cagccacccgaugugcaaggaac

SEQ ID NO: 383 - RNA, 23 nt, Mus musculus
ccacccgaugugcaaggaacacg

SEQ ID NO: 384 - RNA, 23 nt, Mus musculus
ucaacaucuacugucucacgugu

SEQ ID NO: 385 - RNA, 23 nt, Mus musculus
aacaucuacugucucacguguga

SEQ ID NO: 386 - RNA, 23 nt, Mus musculus
caucuacugucucacgugugagg

SEQ ID NO: 387 - RNA, 23 nt, Mus musculus
aucuacugucucacgugugaggu

SEQ ID NO: 388 - RNA, 23 nt, Mus musculus
cuacugucucacgugugaggugc

SEQ ID NO: 389 - RNA, 23 nt, Mus musculus
cugucucacgugugaggugccua

SEQ ID NO: 390 - RNA, 23 nt, Mus musculus
gucucacgugugaggugccuacu

SEQ ID NO: 391 - RNA, 23 nt, Mus musculus
cacgugugaggugccuacuugcu

SEQ ID NO: 392 - RNA, 23 nt, Mus musculus
gugcaagguguuuggggcucacc

SEQ ID NO: 393 - RNA, 23 nt, Mus musculus
cugagcugaguaacugcaucucc

SEQ ID NO: 394 - RNA, 23 nt, Mus musculus
gaguaacugcaucuccaugcugg

SEQ ID NO: 395 - RNA, 23 nt, Mus musculus
caacgaccgagugcagacgauca

SEQ ID NO: 396 - RNA, 23 nt, Mus musculus
accgagugcagacgaucaucucu

SEQ ID NO: 397 - RNA, 23 nt, Mus musculus
gcugcagcggaucacgcaggagc

SEQ ID NO: 398 - RNA, 23 nt, Mus musculus
gcagcggaucacgcaggagcagg

SEQ ID NO: 399 - RNA, 23 nt, Mus musculus
gagcccggaggggcuaccuuccu

SEQ ID NO: 400 - RNA, 23 nt, Mus musculus
ugagaacauggacuacuuuacuc

SEQ ID NO: 401 - RNA, 23 nt, Mus musculus
aacauggacuacuuuacucugga

SEQ ID NO: 402 - RNA, 23 nt, Mus musculus
cauggacuacuuuacucuggacu

SEQ ID NO: 403 - RNA, 23 nt, Mus musculus
gacuacuuuacucuggacuuaga

SEQ ID NO: 404 - RNA, 23 nt, Mus musculus
gaggaagagggcgugaccacaga

SEQ ID NO: 405 - RNA, 23 nt, Mus musculus
uacaauagggaagugugucuucu

SEQ ID NO: 406 - RNA, 23 nt, Mus musculus
acacaauuggaaauguauccaaa

SEQ ID NO: 407 - RNA, 23 nt, Mus musculus
uguauccaaaacgucacaggaca

SEQ ID NO: 408 - RNA, 23 nt, Mus musculus
uauccaaaacgucacaggacacu

SEQ ID NO: 409 - RNA, 23 nt, Mus musculus
ccaaaacgucacaggacacuuuu

SEQ ID NO: 410 - RNA, 23 nt, Mus musculus
caggacacuuuucuacguuggug

SEQ ID NO: 411 - RNA, 23 nt, Mus musculus
acuuuucuacguuggugcgaaau

SEQ ID NO: 412 - RNA, 23 nt, Mus musculus
cuuuucuacguuggugcgaaaug

SEQ ID NO: 413 - RNA, 23 nt, Mus musculus
uucuacguuggugcgaaaugaaa

SEQ ID NO: 414 - RNA, 23 nt, Mus musculus
ucuacguuggugcgaaaugaaau

SEQ ID NO: 415 - RNA, 23 nt, Mus musculus
uacguuggugcgaaaugaaauau

SEQ ID NO: 416 - RNA, 23 nt, Mus musculus
uuggugcgaaaugaaauauuuug

SEQ ID NO: 417 - RNA, 23 nt, Mus musculus
uauauguaugccaauuuggugcu

SEQ ID NO: 418 - RNA, 23 nt, Mus musculus
uguaugccaauuuggugcuuuuu

SEQ ID NO: 419 - RNA, 23 nt, Mus musculus
uaugccaauuuggugcuuuuugu

SEQ ID NO: 420 - RNA, 23 nt, Mus musculus
ugccaauuuggugcuuuuuguac

SEQ ID NO: 421 - RNA, 23 nt, Mus musculus
aauuuggugcuuuuuguacgaga

SEQ ID NO: 422 - RNA, 23 nt, Mus musculus
uuuguacgagaacuuuuguauga

SEQ ID NO: 423 - RNA, 23 nt, Mus musculus
uguacgagaacuuuuguaugauc

SEQ ID NO: 424 - RNA, 23 nt, Mus musculus
guacgagaacuuuuguaugauca

SEQ ID NO: 425 - RNA, 23 nt, Mus musculus
acgagaacuuuuguaugaucacg

SEQ ID NO: 426 - RNA, 23 nt, Mus musculus
gacuggcgauugucacaaagugg

SEQ ID NO: 427 - RNA, 23 nt, Mus musculus
ggauaggacugaauuuguguuau

SEQ ID NO: 428 - RNA, 23 nt, Mus musculus
auaggacugaauuuguguuauau

SEQ ID NO: 429 - RNA, 23 nt, Homo sapiens
ggaagccaacaggauccgacccg

SEQ ID NO: 430 - RNA, 23 nt, Homo sapiens
cccaggucuacuuagagcaaagu

SEQ ID NO: 431 - RNA, 23 nt, Homo sapiens
caggucuacuuagagcaaaguua

SEQ ID NO: 432 - RNA, 23 nt, Homo sapiens
agucgagccugauccaggauggg

SEQ ID NO: 433 - RNA, 23 nt, Homo sapiens
ccaguggucaucuugccgugcca

SEQ ID NO: 434 - RNA, 23 nt, Homo sapiens
gucaucuugccgugccagcacaa

SEQ ID NO: 435 - RNA, 23 nt, Homo sapiens
aucuugccgugccagcacaaccu

SEQ ID NO: 436 - RNA, 23 nt, Homo sapiens
ucuugccgugccagcacaaccug

SEQ ID NO: 437 - RNA, 23 nt, Homo sapiens
ccagcacaaccugugccggaagu

SEQ ID NO: 438 - RNA, 23 nt, Homo sapiens
uguccaugucuggaggccguuuc

SEQ ID NO: 439 - RNA, 23 nt, Homo sapiens
ccccaccugccgccacgagguga

SEQ ID NO: 440 - RNA, 23 nt, Homo sapiens
cccaccugccgccacgaggugau

SEQ ID NO: 441 - RNA, 23 nt, Homo sapiens
caccugccgccacgaggugauca

SEQ ID NO: 442 - RNA, 23 nt, Homo sapiens
accugccgccacgaggugaucau

SEQ ID NO: 443 - RNA, 23 nt, Homo sapiens
ccugccgccacgaggugaucaug

SEQ ID NO: 444 - RNA, 23 nt, Homo sapiens
cugccgccacgaggugaucaugg

SEQ ID NO: 445 - RNA, 23 nt, Homo sapiens
ugccgccacgaggugaucaugga

SEQ ID NO: 446 - RNA, 23 nt, Homo sapiens
gccgccacgaggugaucauggau

SEQ ID NO: 447 - RNA, 23 nt, Homo sapiens
ccacgaggugaucauggaucguc

SEQ ID NO: 448 - RNA, 23 nt, Homo sapiens
cacgaggugaucauggaucguca

SEQ ID NO: 449 - RNA, 23 nt, Homo sapiens
acgaggugaucauggaucgucac

SEQ ID NO: 450 - RNA, 23 nt, Homo sapiens
aggugaucauggaucgucacgga

SEQ ID NO: 451 - RNA, 23 nt, Homo sapiens
ggugaucauggaucgucacggag

SEQ ID NO: 452 - RNA, 23 nt, Homo sapiens
gugaucauggaucgucacggagu

SEQ ID NO: 453 - RNA, 23 nt, Homo sapiens
ugaucauggaucgucacggagug

SEQ ID NO: 454 - RNA, 23 nt, Homo sapiens
caucuacaaacaggagugcucca

SEQ ID NO: 455 - RNA, 23 nt, Homo sapiens
aaacaggagugcuccagucggcc

SEQ ID NO: 456 - RNA, 23 nt, Homo sapiens
aacaggagugcuccagucggccg

SEQ ID NO: 457 - RNA, 23 nt, Homo sapiens
caggagugcuccagucggccgcu

SEQ ID NO: 458 - RNA, 23 nt, Homo sapiens
ggcagucaccccaugugcaagga

SEQ ID NO: 459 - RNA, 23 nt, Homo sapiens
ccccaugugcaaggagcacgaag

SEQ ID NO: 460 - RNA, 23 nt, Homo sapiens
augugcaaggagcacgaagauga

SEQ ID NO: 461 - RNA, 23 nt, Homo sapiens
ucaacaucuacugucucacgugu

SEQ ID NO: 462 - RNA, 23 nt, Homo sapiens
caucuacugucucacgugugagg

SEQ ID NO: 463 - RNA, 23 nt, Homo sapiens
uacugucucacgugugaggugcc

SEQ ID NO: 464 - RNA, 23 nt, Homo sapiens
ccugcuccaugugcaagguguuu

SEQ ID NO: 465 - RNA, 23 nt, Homo sapiens
cuccaugugcaagguguuuggga

SEQ ID NO: 466 - RNA, 23 nt, Homo sapiens
ggccccauugcagagugucuucc

SEQ ID NO: 467 - RNA, 23 nt, Homo sapiens
ccccauugcagagugucuuccag

SEQ ID NO: 468 - RNA, 23 nt, Homo sapiens
cugaacugaauaacuguaucucc

SEQ ID NO: 469 - RNA, 23 nt, Homo sapiens
gaacugaauaacuguaucuccau

SEQ ID NO: 470 - RNA, 23 nt, Homo sapiens
gcugguggcggggaaugaccgug

SEQ ID NO: 471 - RNA, 23 nt, Homo sapiens
cugguggcggggaaugaccgugu

SEQ ID NO: 472 - RNA, 23 nt, Homo sapiens
ugguggcggggaaugaccgugug

SEQ ID NO: 473 - RNA, 23 nt, Homo sapiens
gguggcggggaaugaccgugugc

SEQ ID NO: 474 - RNA, 23 nt, Homo sapiens
aaaagugaguugcugcagcggau

SEQ ID NO: 475 - RNA, 23 nt, Homo sapiens
agcuucaucgaggcccucaucca

SEQ ID NO: 476 - RNA, 23 nt, Homo sapiens
cucuugacugccaagcaacucau

SEQ ID NO: 477 - RNA, 23 nt, Homo sapiens
cuugacugccaagcaacucauca

SEQ ID NO: 478 - RNA, 23 nt, Homo sapiens
gccaagcaacucaucaaaagcau

SEQ ID NO: 479 - RNA, 23 nt, Homo sapiens
caagcaacucaucaaaagcauug

SEQ ID NO: 480 - RNA, 23 nt, Homo sapiens
aagcaacucaucaaaagcauugu

SEQ ID NO: 481 - RNA, 19 nt, Artificial Sequence
  Description of Artificial Sequence: Synthetic oligonucleotide
ggauccgaguggguuugga

SEQ ID NO: 482 - RNA, 19 nt, Artificial Sequence
  Description of Artificial Sequence: Synthetic oligonucleotide
agacagucgcauuucaaag

SEQ ID NO: 483 - RNA, 19 nt, Artificial Sequence
  Description of Artificial Sequence: Synthetic oligonucleotide
auuauaaaucuagccugau

SEQ ID NO: 484 - RNA, 19 nt, Artificial Sequence
  Description of Artificial Sequence: Synthetic oligonucleotide
cugauggaaacgcuaugga

SEQ ID NO: 485 - RNA, 19 nt, Artificial Sequence
  Description of Artificial Sequence: Synthetic oligonucleotide
gcugcgaaucccuacugga

SEQ ID NO: 486 - RNA, 19 nt, Artificial Sequence
  Description of Artificial Sequence: Synthetic oligonucleotide
cguuuccguugccccucgu

SEQ ID NO: 487 - RNA, 19 nt, Artificial Sequence
  Description of Artificial Sequence: Synthetic oligonucleotide
gccccucgugccgccauga

SEQ ID NO: 488 - RNA, 19 nt, Artificial Sequence
  Description of Artificial Sequence: Synthetic oligonucleotide
ccccucgugccgccaugaa

SEQ ID NO: 489 - RNA, 19 nt, Artificial Sequence
  Description of Artificial Sequence: Synthetic oligonucleotide
cccucgugccgccaugaag

SEQ ID NO: 490 - RNA, 19 nt, Artificial Sequence
  Description of Artificial Sequence: Synthetic oligonucleotide
gccgccaugaagugaucau

SEQ ID NO: 491 - RNA, 19 nt, Artificial Sequence
  Description of Artificial Sequence: Synthetic oligonucleotide
aagugaucauggaccggca

SEQ ID NO: 492 - RNA, 19 nt, Artificial Sequence
  Description of Artificial Sequence: Synthetic oligonucleotide
caggagugcuccagucggc

SEQ ID NO: 493 - RNA, 19 nt, Artificial Sequence
  Description of Artificial Sequence: Synthetic oligonucleotide
gccacccgaugugcaagga

SEQ ID NO: 494 - RNA, 19 nt, Artificial Sequence
  Description of Artificial Sequence: Synthetic oligonucleotide
acccgaugugcaaggaaca

SEQ ID NO: 495 - RNA, 19 nt, Artificial Sequence
  Description of Artificial Sequence: Synthetic oligonucleotide
aacaucuacugucucacgu

SEQ ID NO: 496 - RNA, 19 nt, Artificial Sequence
  Description of Artificial Sequence: Synthetic oligonucleotide
caucuacugucucacgugu

SEQ ID NO: 497 - RNA, 19 nt, Artificial Sequence
  Description of Artificial Sequence: Synthetic oligonucleotide
ucuacugucucacguguga

SEQ ID NO: 498 - RNA, 19 nt, Artificial Sequence
  Description of Artificial Sequence: Synthetic oligonucleotide
cuacugucucacgugugag

SEQ ID NO: 499 - RNA, 19 nt, Artificial Sequence
  Description of Artificial Sequence: Synthetic oligonucleotide
acugucucacgugugaggu

SEQ ID NO: 500 - RNA, 19 nt, Artificial Sequence
  Description of Artificial Sequence: Synthetic oligonucleotide
gucucacgugugaggugcc

SEQ ID NO: 501 - RNA, 19 nt, Artificial Sequence
  Description of Artificial Sequence: Synthetic oligonucleotide
cucacgugugaggugccua

SEQ ID NO: 502 - RNA, 19 nt, Artificial Sequence
  Description of Artificial Sequence: Synthetic oligonucleotide
cgugugaggugccuacuug

SEQ ID NO: 503 - RNA, 19 nt, Artificial Sequence
  Description of Artificial Sequence: Synthetic oligonucleotide
gcaagguguuuggggcuca

SEQ ID NO: 504 - RNA, 19 nt, Artificial Sequence
  Description of Artificial Sequence: Synthetic oligonucleotide
gagcugaguaacugcaucu

SEQ ID NO: 505 - RNA, 19 nt, Artificial Sequence
  Description of Artificial Sequence: Synthetic oligonucleotide
guaacugcaucuccaugcu

SEQ ID NO: 506 - RNA, 19 nt, Artificial Sequence
  Description of Artificial Sequence: Synthetic oligonucleotide
acgaccgagugcagacgau

SEQ ID NO: 507 - RNA, 19 nt, Artificial Sequence
  Description of Artificial Sequence: Synthetic oligonucleotide
cgagugcagacgaucaucu

SEQ ID NO: 508 - RNA, 19 nt, Artificial Sequence
  Description of Artificial Sequence: Synthetic oligonucleotide
ugcagcggaucacgcagga

SEQ ID NO: 509 - RNA, 19 nt, Artificial Sequence
  Description of Artificial Sequence: Synthetic oligonucleotide
agcggaucacgcaggagca

SEQ ID NO: 510 - RNA, 19 nt, Artificial Sequence
  Description of Artificial Sequence: Synthetic oligonucleotide
gcccggaggggcuaccuuc

SEQ ID NO: 511 - RNA, 19 nt, Artificial Sequence
  Description of Artificial Sequence: Synthetic oligonucleotide
agaacauggacuacuuuac

SEQ ID NO: 512 - RNA, 19 nt, Artificial Sequence
  Description of Artificial Sequence: Synthetic oligonucleotide
cauggacuacuuuacucug

SEQ ID NO: 513 - RNA, 19 nt, Artificial Sequence
  Description of Artificial Sequence: Synthetic oligonucleotide
uggacuacuuuacucugga

SEQ ID NO: 514 - RNA, 19 nt, Artificial Sequence
  Description of Artificial Sequence: Synthetic oligonucleotide
cuacuuuacucuggacuua

SEQ ID NO: 515 - RNA, 19 nt, Artificial Sequence
  Description of Artificial Sequence: Synthetic oligonucleotide
ggaagagggcgugaccaca

SEQ ID NO: 516 - RNA, 19 nt, Artificial Sequence
  Description of Artificial Sequence: Synthetic oligonucleotide
caauagggaagugugucuu

SEQ ID NO: 517 - RNA, 19 nt, Artificial Sequence
  Description of Artificial Sequence: Synthetic oligonucleotide
acaauuggaaauguaucca

SEQ ID NO: 518 - RNA, 19 nt, Artificial Sequence
  Description of Artificial Sequence: Synthetic oligonucleotide
uauccaaaacgucacagga

SEQ ID NO: 519 - RNA, 19 nt, Artificial Sequence
  Description of Artificial Sequence: Synthetic oligonucleotide
uccaaaacgucacaggaca

SEQ ID NO: 520 - RNA, 19 nt, Artificial Sequence
  Description of Artificial Sequence: Synthetic oligonucleotide
aaaacgucacaggacacuu

SEQ ID NO: 521 - RNA, 19 nt, Artificial Sequence
  Description of Artificial Sequence: Synthetic oligonucleotide
ggacacuuuucuacguugg

SEQ ID NO: 522 - RNA, 19 nt, Artificial Sequence
  Description of Artificial Sequence: Synthetic oligonucleotide
uuuucuacguuggugcgaa

SEQ ID NO: 523 - RNA, 19 nt, Artificial Sequence
  Description of Artificial Sequence: Synthetic oligonucleotide
uuucuacguuggugcgaaa

SEQ ID NO: 524 - RNA, 19 nt, Artificial Sequence
  Description of Artificial Sequence: Synthetic oligonucleotide
cuacguuggugcgaaauga

SEQ ID NO: 525 - RNA, 19 nt, Artificial Sequence
  Description of Artificial Sequence: Synthetic oligonucleotide
uacguuggugcgaaaugaa

SEQ ID NO: 526 - RNA, 19 nt, Artificial Sequence
  Description of Artificial Sequence: Synthetic oligonucleotide
cguuggugcgaaaugaaau

SEQ ID NO: 527 - RNA, 19 nt, Artificial Sequence
  Description of Artificial Sequence: Synthetic oligonucleotide
ggugcgaaaugaaauauuu

SEQ ID NO: 528 - RNA, 19 nt, Artificial Sequence
  Description of Artificial Sequence: Synthetic oligonucleotide
uauguaugccaauuuggug

SEQ ID NO: 529 - RNA, 19 nt, Artificial Sequence
  Description of Artificial Sequence: Synthetic oligonucleotide
uaugccaauuuggugcuuu

SEQ ID NO: 530 - RNA, 19 nt, Artificial Sequence
  Description of Artificial Sequence: Synthetic oligonucleotide
ugccaauuuggugcuuuuu

SEQ ID NO: 531 - RNA, 19 nt, Artificial Sequence
  Description of Artificial Sequence: Synthetic oligonucleotide
ccaauuuggugcuuuuugu

SEQ ID NO: 532 - RNA, 19 nt, Artificial Sequence
  Description of Artificial Sequence: Synthetic oligonucleotide
uuuggugcuuuuuguacga

SEQ ID NO: 533 - RNA, 19 nt, Artificial Sequence
  Description of Artificial Sequence: Synthetic oligonucleotide
uguacgagaacuuuuguau

SEQ ID NO: 534 - RNA, 19 nt, Artificial Sequence
  Description of Artificial Sequence: Synthetic oligonucleotide
uacgagaacuuuuguauga

SEQ ID NO: 535 - RNA, 19 nt, Artificial Sequence
  Description of Artificial Sequence: Synthetic oligonucleotide
acgagaacuuuuguaugau

SEQ ID NO: 536 - RNA, 19 nt, Artificial Sequence
  Description of Artificial Sequence: Synthetic oligonucleotide
gagaacuuuuguaugauca

SEQ ID NO: 537 - RNA, 19 nt, Artificial Sequence
  Description of Artificial Sequence: Synthetic oligonucleotide
cuggcgauugucacaaagu

SEQ ID NO: 538 - RNA, 19 nt, Artificial Sequence
  Description of Artificial Sequence: Synthetic oligonucleotide
auaggacugaauuuguguu

SEQ ID NO: 539 - RNA, 19 nt, Artificial Sequence
  Description of Artificial Sequence: Synthetic oligonucleotide
aggacugaauuuguguuau

SEQ ID NO: 540 - RNA, 19 nt, Artificial Sequence
  Description of Artificial Sequence: Synthetic oligonucleotide
aagccaacaggauccgacc

SEQ ID NO: 541 - RNA, 19 nt, Artificial Sequence
  Description of Artificial Sequence: Synthetic oligonucleotide
caggucuacuuagagcaaa

SEQ ID NO: 542 - RNA, 19 nt, Artificial Sequence
  Description of Artificial Sequence: Synthetic oligonucleotide
ggucuacuuagagcaaagu

SEQ ID NO: 543 - RNA, 19 nt, Artificial Sequence
  Description of Artificial Sequence: Synthetic oligonucleotide
ucgagccugauccaggaug

SEQ ID NO: 544 - RNA, 19 nt, Artificial Sequence
  Description of Artificial Sequence: Synthetic oligonucleotide
aguggucaucuugccgugc

SEQ ID NO: 545 - RNA, 19 nt, Artificial Sequence
  Description of Artificial Sequence: Synthetic oligonucleotide
caucuugccgugccagcac

SEQ ID NO: 546 - RNA, 19 nt, Artificial Sequence
  Description of Artificial Sequence: Synthetic oligonucleotide
cuugccgugccagcacaac

SEQ ID NO: 547 - RNA, 19 nt, Artificial Sequence
  Description of Artificial Sequence: Synthetic oligonucleotide
uugccgugccagcacaacc

SEQ ID NO: 548 - RNA, 19 nt, Artificial Sequence
  Description of Artificial Sequence: Synthetic oligonucleotide
agcacaaccugugccggaa

SEQ ID NO: 549 - RNA, 19 nt, Artificial Sequence
  Description of Artificial Sequence: Synthetic oligonucleotide
uccaugucuggaggccguu

SEQ ID NO: 550 - RNA, 19 nt, Artificial Sequence
  Description of Artificial Sequence: Synthetic oligonucleotide
ccaccugccgccacgaggu

SEQ ID NO: 551 - RNA, 19 nt, Artificial Sequence
  Description of Artificial Sequence: Synthetic oligonucleotide
caccugccgccacgaggug

SEQ ID NO: 552 - RNA, 19 nt, Artificial Sequence
  Description of Artificial Sequence: Synthetic oligonucleotide
ccugccgccacgaggugau

SEQ ID NO: 553 - RNA, 19 nt, Artificial Sequence
  Description of Artificial Sequence: Synthetic oligonucleotide
cugccgccacgaggugauc

SEQ ID NO: 554 - RNA, 19 nt, Artificial Sequence
  Description of Artificial Sequence: Synthetic oligonucleotide
ugccgccacgaggugauca

SEQ ID NO: 555 - RNA, 19 nt, Artificial Sequence
  Description of Artificial Sequence: Synthetic oligonucleotide
gccgccacgaggugaucau

SEQ ID NO: 556 - RNA, 19 nt, Artificial Sequence
  Description of Artificial Sequence: Synthetic oligonucleotide
ccgccacgaggugaucaug

SEQ ID NO: 557 - RNA, 19 nt, Artificial Sequence
  Description of Artificial Sequence: Synthetic oligonucleotide
cgccacgaggugaucaugg

SEQ ID NO: 558 - RNA, 19 nt, Artificial Sequence
  Description of Artificial Sequence: Synthetic oligonucleotide
acgaggugaucauggaucg

SEQ ID NO: 559 - RNA, 19 nt, Artificial Sequence
  Description of Artificial Sequence: Synthetic oligonucleotide
cgaggugaucauggaucgu

SEQ ID NO: 560 - RNA, 19 nt, Artificial Sequence
  Description of Artificial Sequence: Synthetic oligonucleotide
gaggugaucauggaucguc

SEQ ID NO: 561 - RNA, 19 nt, Artificial Sequence
  Description of Artificial Sequence: Synthetic oligonucleotide
gugaucauggaucgucacg

SEQ ID NO: 562 - RNA, 19 nt, Artificial Sequence
  Description of Artificial Sequence: Synthetic oligonucleotide
ugaucauggaucgucacgg

SEQ ID NO: 563 - RNA, 19 nt, Artificial Sequence
  Description of Artificial Sequence: Synthetic oligonucleotide
gaucauggaucgucacgga

SEQ ID NO: 564 - RNA, 19 nt, Artificial Sequence
  Description of Artificial Sequence: Synthetic oligonucleotide
aucauggaucgucacggag

SEQ ID NO: 565 - RNA, 19 nt, Artificial Sequence
  Description of Artificial Sequence: Synthetic oligonucleotide
ucuacaaacaggagugcuc

SEQ ID NO: 566 - RNA, 19 nt, Artificial Sequence
  Description of Artificial Sequence: Synthetic oligonucleotide
acaggagugcuccagucgg

SEQ ID NO: 567 - RNA, 19 nt, Artificial Sequence
  Description of Artificial Sequence: Synthetic oligonucleotide
caggagugcuccagucggc

SEQ ID NO: 568 - RNA, 19 nt, Artificial Sequence
  Description of Artificial Sequence: Synthetic oligonucleotide
ggagugcuccagucggccg

SEQ ID NO: 569 - RNA, 19 nt, Artificial Sequence
  Description of Artificial Sequence: Synthetic oligonucleotide
cagucaccccaugugcaag

SEQ ID NO: 570 - RNA, 19 nt, Artificial Sequence
  Description of Artificial Sequence: Synthetic oligonucleotide
ccaugugcaaggagcacga

SEQ ID NO: 571 - RNA, 19 nt, Artificial Sequence
  Description of Artificial Sequence: Synthetic oligonucleotide
gugcaaggagcacgaagau

SEQ ID NO: 572 - RNA, 19 nt, Artificial Sequence
  Description of Artificial Sequence: Synthetic oligonucleotide
aacaucuacugucucacgu

SEQ ID NO: 573 - RNA, 19 nt, Artificial Sequence
  Description of Artificial Sequence: Synthetic oligonucleotide
ucuacugucucacguguga

SEQ ID NO: 574 - RNA, 19 nt, Artificial Sequence
  Description of Artificial Sequence: Synthetic oligonucleotide
cugucucacgugugaggug

SEQ ID NO: 575 - RNA, 19 nt, Artificial Sequence
  Description of Artificial Sequence: Synthetic oligonucleotide
ugcuccaugugcaaggugu

SEQ ID NO: 576 - RNA, 19 nt, Artificial Sequence
  Description of Artificial Sequence: Synthetic oligonucleotide
ccaugugcaagguguuugg

SEQ ID NO: 577 - RNA, 19 nt, Artificial Sequence
  Description of Artificial Sequence: Synthetic oligonucleotide
ccccauugcagagugucuu

SEQ ID NO: 578 - RNA, 19 nt, Artificial Sequence
  Description of Artificial Sequence: Synthetic oligonucleotide
ccauugcagagugucuucc

SEQ ID NO: 579 - RNA, 19 nt, Artificial Sequence
  Description of Artificial Sequence: Synthetic oligonucleotide
gaacugaauaacuguaucu

SEQ ID NO: 580 - RNA, 19 nt, Artificial Sequence
  Description of Artificial Sequence: Synthetic oligonucleotide
acugaauaacuguaucucc

SEQ ID NO: 581 - RNA, 19 nt, Artificial Sequence
  Description of Artificial Sequence: Synthetic oligonucleotide
ugguggcggggaaugaccg

SEQ ID NO: 582 - RNA, 19 nt, Artificial Sequence
  Description of Artificial Sequence: Synthetic oligonucleotide
gguggcggggaaugaccgu

SEQ ID NO: 583 - RNA, 19 nt, Artificial Sequence
  Description of Artificial Sequence: Synthetic oligonucleotide
guggcggggaaugaccgug

SEQ ID NO: 584 - RNA, 19 nt, Artificial Sequence
  Description of Artificial Sequence: Synthetic oligonucleotide
uggcggggaaugaccgugu

SEQ ID NO: 585 - RNA, 19 nt, Artificial Sequence
  Description of Artificial Sequence: Synthetic oligonucleotide
aagugaguugcugcagcgg

SEQ ID NO: 586 - RNA, 19 nt, Artificial Sequence
  Description of Artificial Sequence: Synthetic oligonucleotide
cuucaucgaggcccucauc

SEQ ID NO: 587 - RNA, 19 nt, Artificial Sequence
  Description of Artificial Sequence: Synthetic oligonucleotide
cuugacugccaagcaacuc

SEQ ID NO: 588 - RNA, 19 nt, Artificial Sequence
  Description of Artificial Sequence: Synthetic oligonucleotide
ugacugccaagcaacucau

SEQ ID NO: 589 - RNA, 19 nt, Artificial Sequence
  Description of Artificial Sequence: Synthetic oligonucleotide
caagcaacucaucaaaagc

SEQ ID NO: 590 - RNA, 19 nt, Artificial Sequence
  Description of Artificial Sequence: Synthetic oligonucleotide
agcaacucaucaaaagcau

SEQ ID NO: 591 - RNA, 19 nt, Artificial Sequence
  Description of Artificial Sequence: Synthetic oligonucleotide
gcaacucaucaaaagcauu

SEQ ID NO: 592 - RNA, 19 nt, Artificial Sequence
  Description of Artificial Sequence: Synthetic oligonucleotide
uccaaacccacucggaucc

SEQ ID NO: 593 - RNA, 19 nt, Artificial Sequence
  Description of Artificial Sequence: Synthetic oligonucleotide
cuuugaaaugcgacugucu

SEQ ID NO: 594 - RNA, 19 nt, Artificial Sequence
  Description of Artificial Sequence: Synthetic oligonucleotide
aucaggcuagauuuauaau

SEQ ID NO: 595 - RNA, 19 nt, Artificial Sequence
  Description of Artificial Sequence: Synthetic oligonucleotide
uccauagcguuuccaucag

SEQ ID NO: 596 - RNA, 19 nt, Artificial Sequence
  Description of Artificial Sequence: Synthetic oligonucleotide
uccaguagggauucgcagc

SEQ ID NO: 597 - RNA, 19 nt, Artificial Sequence
  Description of Artificial Sequence: Synthetic oligonucleotide
acgaggggcaacggaaacg

SEQ ID NO: 598 - RNA, 19 nt, Artificial Sequence
  Description of Artificial Sequence: Synthetic oligonucleotide
ucauggcggcacgaggggc

SEQ ID NO: 599 - RNA, 19 nt, Artificial Sequence
  Description of Artificial Sequence: Synthetic oligonucleotide
uucauggcggcacgagggg

SEQ ID NO: 600 - RNA, 19 nt, Artificial Sequence
  Description of Artificial Sequence: Synthetic oligonucleotide
cuucauggcggcacgaggg

SEQ ID NO: 601 - RNA, 19 nt, Artificial Sequence
  Description of Artificial Sequence: Synthetic oligonucleotide
augaucacuucauggcggc

SEQ ID NO: 602 - RNA, 19 nt, Artificial Sequence
  Description of Artificial Sequence: Synthetic oligonucleotide
ugccgguccaugaucacuu

SEQ ID NO: 603 - RNA, 19 nt, Artificial Sequence
  Description of Artificial Sequence: Synthetic oligonucleotide
gccgacuggagcacuccug

SEQ ID NO: 604 - RNA, 19 nt, Artificial Sequence
  Description of Artificial Sequence: Synthetic oligonucleotide
uccuugcacaucggguggc

SEQ ID NO: 605 - RNA, 19 nt, Artificial Sequence
  Description of Artificial Sequence: Synthetic oligonucleotide
uguuccuugcacaucgggu

SEQ ID NO: 606 - RNA, 19 nt, Artificial Sequence
  Description of Artificial Sequence: Synthetic oligonucleotide
acgugagacaguagauguu

SEQ ID NO: 607 - RNA, 19 nt, Artificial Sequence
  Description of Artificial Sequence: Synthetic oligonucleotide
acacgugagacaguagaug

SEQ ID NO: 608 - RNA, 19 nt, Artificial Sequence
  Description of Artificial Sequence: Synthetic oligonucleotide
ucacacgugagacaguaga

SEQ ID NO: 609 - RNA, 19 nt, Artificial Sequence
  Description of Artificial Sequence: Synthetic oligonucleotide
cucacacgugagacaguag

SEQ ID NO: 610 - RNA, 19 nt, Artificial Sequence
  Description of Artificial Sequence: Synthetic oligonucleotide
accucacacgugagacagu

SEQ ID NO: 611 - RNA, 19 nt, Artificial Sequence
  Description of Artificial Sequence: Synthetic oligonucleotide
ggcaccucacacgugagac

SEQ ID NO: 612 - RNA, 19 nt, Artificial Sequence
  Description of Artificial Sequence: Synthetic oligonucleotide
uaggcaccucacacgugag

SEQ ID NO: 613 - RNA, 19 nt, Artificial Sequence
  Description of Artificial Sequence: Synthetic oligonucleotide
caaguaggcaccucacacg

SEQ ID NO: 614 - RNA, 19 nt, Artificial Sequence
  Description of Artificial Sequence: Synthetic oligonucleotide
ugagccccaaacaccuugc

SEQ ID NO: 615 - RNA, 19 nt, Artificial Sequence
  Description of Artificial Sequence: Synthetic oligonucleotide
agaugcaguuacucagcuc

SEQ ID NO: 616 - RNA, 19 nt, Artificial Sequence
  Description of Artificial Sequence: Synthetic oligonucleotide
agcauggagaugcaguuac

SEQ ID NO: 617 - RNA, 19 nt, Artificial Sequence
  Description of Artificial Sequence: Synthetic oligonucleotide
aucgucugcacucggucgu

SEQ ID NO: 618 - RNA, 19 nt, Artificial Sequence
  Description of Artificial Sequence: Synthetic oligonucleotide
agaugaucgucugcacucg

SEQ ID NO: 619 - RNA, 19 nt, Artificial Sequence
  Description of Artificial Sequence: Synthetic oligonucleotide
uccugcgugauccgcugca

SEQ ID NO: 620 - RNA, 19 nt, Artificial Sequence
  Description of Artificial Sequence: Synthetic oligonucleotide
ugcuccugcgugauccgcu

SEQ ID NO: 621 - RNA, 19 nt, Artificial Sequence
  Description of Artificial Sequence: Synthetic oligonucleotide
gaagguagccccuccgggc

SEQ ID NO: 622 - RNA, 19 nt, Artificial Sequence
  Description of Artificial Sequence: Synthetic oligonucleotide
guaaaguaguccauguucu

SEQ ID NO: 623 - RNA, 19 nt, Artificial Sequence
  Description of Artificial Sequence: Synthetic oligonucleotide
cagaguaaaguaguccaug

SEQ ID NO: 624 - RNA, 19 nt, Artificial Sequence
  Description of Artificial Sequence: Synthetic oligonucleotide
uccagaguaaaguagucca

SEQ ID NO: 625 - RNA, 19 nt, Artificial Sequence
  Description of Artificial Sequence: Synthetic oligonucleotide
uaaguccagaguaaaguag

SEQ ID NO: 626 - RNA, 19 nt, Artificial Sequence
  Description of Artificial Sequence: Synthetic oligonucleotide
uguggucacgcccucuucc

SEQ ID NO: 627 - RNA, 19 nt, Artificial Sequence
  Description of Artificial Sequence: Synthetic oligonucleotide
aagacacacuucccuauug

SEQ ID NO: 628 - RNA, 19 nt, Artificial Sequence
  Description of Artificial Sequence: Synthetic oligonucleotide
uggauacauuuccaauugu

SEQ ID NO: 629 - RNA, 19 nt, Artificial Sequence
  Description of Artificial Sequence: Synthetic oligonucleotide
uccugugacguuuuggaua

SEQ ID NO: 630 - RNA, 19 nt, Artificial Sequence
  Description of Artificial Sequence: Synthetic oligonucleotide
uguccugugacguuuugga

SEQ ID NO: 631 - RNA, 19 nt, Artificial Sequence
  Description of Artificial Sequence: Synthetic oligonucleotide
aaguguccugugacguuuu

SEQ ID NO: 632 - RNA, 19 nt, Artificial Sequence
  Description of Artificial Sequence: Synthetic oligonucleotide
ccaacguagaaaagugucc

SEQ ID NO: 633 - RNA, 19 nt, Artificial Sequence
  Description of Artificial Sequence: Synthetic oligonucleotide
uucgcaccaacguagaaaa

SEQ ID NO: 634 - RNA, 19 nt, Artificial Sequence
  Description of Artificial Sequence: Synthetic oligonucleotide
uuucgcaccaacguagaaa

SEQ ID NO: 635 - RNA, 19 nt, Artificial Sequence
  Description of Artificial Sequence: Synthetic oligonucleotide
ucauuucgcaccaacguag

SEQ ID NO: 636 - RNA, 19 nt, Artificial Sequence
  Description of Artificial Sequence: Synthetic oligonucleotide
uucauuucgcaccaacgua

SEQ ID NO: 637 - RNA, 19 nt, Artificial Sequence
  Description of Artificial Sequence: Synthetic oligonucleotide
auuucauuucgcaccaacg

SEQ ID NO: 638 - RNA, 19 nt, Artificial Sequence
  Description of Artificial Sequence: Synthetic oligonucleotide
aaauauuucauuucgcacc

SEQ ID NO: 639 - RNA, 19 nt, Artificial Sequence
  Description of Artificial Sequence: Synthetic oligonucleotide
caccaaauuggcauacaua

SEQ ID NO: 640 - RNA, 19 nt, Artificial Sequence
  Description of Artificial Sequence: Synthetic oligonucleotide
aaagcaccaaauuggcaua

SEQ ID NO: 641 - RNA, 19 nt, Artificial Sequence
  Description of Artificial Sequence: Synthetic oligonucleotide
aaaaagcaccaaauuggca

SEQ ID NO: 642 - RNA, 19 nt, Artificial Sequence
  Description of Artificial Sequence: Synthetic oligonucleotide
acaaaaagcaccaaauugg

SEQ ID NO: 643 - RNA, 19 nt, Artificial Sequence
  Description of Artificial Sequence: Synthetic oligonucleotide
ucguacaaaaagcaccaaa

SEQ ID NO: 644 - RNA, 19 nt, Artificial Sequence
  Description of Artificial Sequence: Synthetic oligonucleotide
auacaaaaguucucguaca

SEQ ID NO: 645 - RNA, 19 nt, Artificial Sequence
  Description of Artificial Sequence: Synthetic oligonucleotide
ucauacaaaaguucucgua

SEQ ID NO: 646 - RNA, 19 nt, Artificial Sequence
  Description of Artificial Sequence: Synthetic oligonucleotide
aucauacaaaaguucucgu

SEQ ID NO: 647 - RNA, 19 nt, Artificial Sequence
  Description of Artificial Sequence: Synthetic oligonucleotide
ugaucauacaaaaguucuc

SEQ ID NO: 648 - RNA, 19 nt, Artificial Sequence
  Description of Artificial Sequence: Synthetic oligonucleotide
acuuugugacaaucgccag

SEQ ID NO: 649 - RNA, 19 nt, Artificial Sequence
  Description of Artificial Sequence: Synthetic oligonucleotide
aacacaaauucaguccuau

SEQ ID NO: 650 - RNA, 19 nt, Artificial Sequence
  Description of Artificial Sequence: Synthetic oligonucleotide
auaacacaaauucaguccu

SEQ ID NO: 651 - RNA, 19 nt, Artificial Sequence
  Description of Artificial Sequence: Synthetic oligonucleotide
ggucggauccuguuggcuu

SEQ ID NO: 652 - RNA, 19 nt, Artificial Sequence
  Description of Artificial Sequence: Synthetic oligonucleotide
uuugcucuaaguagaccug

SEQ ID NO: 653 - RNA, 19 nt, Artificial Sequence
  Description of Artificial Sequence: Synthetic oligonucleotide
acuuugcucuaaguagacc

SEQ ID NO: 654 - RNA, 19 nt, Artificial Sequence
  Description of Artificial Sequence: Synthetic oligonucleotide
cauccuggaucaggcucga

SEQ ID NO: 655 - RNA, 19 nt, Artificial Sequence
  Description of Artificial Sequence: Synthetic oligonucleotide
gcacggcaagaugaccacu

SEQ ID NO: 656 - RNA, 19 nt, Artificial Sequence
  Description of Artificial Sequence: Synthetic oligonucleotide
gugcuggcacggcaagaug

SEQ ID NO: 657 - RNA, 19 nt, Artificial Sequence
  Description of Artificial Sequence: Synthetic oligonucleotide
guugugcuggcacggcaag

SEQ ID NO: 658 - RNA, 19 nt, Artificial Sequence
  Description of Artificial Sequence: Synthetic oligonucleotide
gguugugcuggcacggcaa

SEQ ID NO: 659 - RNA, 19 nt, Artificial Sequence
  Description of Artificial Sequence: Synthetic oligonucleotide
uuccggcacagguugugcu

SEQ ID NO: 660 - RNA, 19 nt, Artificial Sequence
  Description of Artificial Sequence: Synthetic oligonucleotide
aacggccuccagacaugga

SEQ ID NO: 661 - RNA, 19 nt, Artificial Sequence
  Description of Artificial Sequence: Synthetic oligonucleotide
accucguggcggcaggugg

SEQ ID NO: 662 - RNA, 19 nt, Artificial Sequence
  Description of Artificial Sequence: Synthetic oligonucleotide
caccucguggcggcaggug

SEQ ID NO: 663 - RNA, 19 nt, Artificial Sequence
  Description of Artificial Sequence: Synthetic oligonucleotide
aucaccucguggcggcagg

SEQ ID NO: 664 - RNA, 19 nt, Artificial Sequence
  Description of Artificial Sequence: Synthetic oligonucleotide
gaucaccucguggcggcag

SEQ ID NO: 665 - RNA, 19 nt, Artificial Sequence
  Description of Artificial Sequence: Synthetic oligonucleotide
ugaucaccucguggcggca

SEQ ID NO: 666 - RNA, 19 nt, Artificial Sequence
  Description of Artificial Sequence: Synthetic oligonucleotide
augaucaccucguggcggc

SEQ ID NO: 667 - RNA, 19 nt, Artificial Sequence
  Description of Artificial Sequence: Synthetic oligonucleotide
caugaucaccucguggcgg

SEQ ID NO: 668 - RNA, 19 nt, Artificial Sequence
  Description of Artificial Sequence: Synthetic oligonucleotide
ccaugaucaccucguggcg

SEQ ID NO: 669 - RNA, 19 nt, Artificial Sequence
  Description of Artificial Sequence: Synthetic oligonucleotide
cgauccaugaucaccucgu

SEQ ID NO: 670 - RNA, 19 nt, Artificial Sequence
  Description of Artificial Sequence: Synthetic oligonucleotide
acgauccaugaucaccucg

SEQ ID NO: 671 - RNA, 19 nt, Artificial Sequence
  Description of Artificial Sequence: Synthetic oligonucleotide
gacgauccaugaucaccuc

SEQ ID NO: 672 - RNA, 19 nt, Artificial Sequence
  Description of Artificial Sequence: Synthetic oligonucleotide
cgugacgauccaugaucac

SEQ ID NO: 673 - RNA, 19 nt, Artificial Sequence
  Description of Artificial Sequence: Synthetic oligonucleotide
ccgugacgauccaugauca

SEQ ID NO: 674 - RNA, 19 nt, Artificial Sequence
  Description of Artificial Sequence: Synthetic oligonucleotide
uccgugacgauccaugauc

SEQ ID NO: 675 - RNA, 19 nt, Artificial Sequence
  Description of Artificial Sequence: Synthetic oligonucleotide
cuccgugacgauccaugau

SEQ ID NO: 676 - RNA, 19 nt, Artificial Sequence
  Description of Artificial Sequence: Synthetic oligonucleotide
gagcacuccuguuuguaga

SEQ ID NO: 677 - RNA, 19 nt, Artificial Sequence
  Description of Artificial Sequence: Synthetic oligonucleotide
ccgacuggagcacuccugu

SEQ ID NO: 678 - RNA, 19 nt, Artificial Sequence
  Description of Artificial Sequence: Synthetic oligonucleotide
gccgacuggagcacuccug

SEQ ID NO: 679 - RNA, 19 nt, Artificial Sequence
  Description of Artificial Sequence: Synthetic oligonucleotide
cggccgacuggagcacucc

SEQ ID NO: 680 - RNA, 19 nt, Artificial Sequence
  Description of Artificial Sequence: Synthetic oligonucleotide
cuugcacauggggugacug

SEQ ID NO: 681 - RNA, 19 nt, Artificial Sequence
  Description of Artificial Sequence: Synthetic oligonucleotide
ucgugcuccuugcacaugg

SEQ ID NO: 682 - RNA, 19 nt, Artificial Sequence
  Description of Artificial Sequence: Synthetic oligonucleotide
aucuucgugcuccuugcac

SEQ ID NO: 683 - RNA, 19 nt, Artificial Sequence
  Description of Artificial Sequence: Synthetic oligonucleotide
acgugagacaguagauguu

SEQ ID NO: 684 - RNA, 19 nt, Artificial Sequence
  Description of Artificial Sequence: Synthetic oligonucleotide
ucacacgugagacaguaga

SEQ ID NO: 685 - RNA, 19 nt, Artificial Sequence
  Description of Artificial Sequence: Synthetic oligonucleotide
caccucacacgugagacag

SEQ ID NO: 686 - RNA, 19 nt, Artificial Sequence
  Description of Artificial Sequence: Synthetic oligonucleotide
acaccuugcacauggagca

SEQ ID NO: 687 - RNA, 19 nt, Artificial Sequence
  Description of Artificial Sequence: Synthetic oligonucleotide
ccaaacaccuugcacaugg

SEQ ID NO: 688 - RNA, 19 nt, Artificial Sequence
  Description of Artificial Sequence: Synthetic oligonucleotide
aagacacucugcaaugggg

SEQ ID NO: 689 - RNA, 19 nt, Artificial Sequence
  Description of Artificial Sequence: Synthetic oligonucleotide
ggaagacacucugcaaugg

SEQ ID NO: 690 - RNA, 19 nt, Artificial Sequence
  Description of Artificial Sequence: Synthetic oligonucleotide
agauacaguuauucaguuc

SEQ ID NO: 691 - RNA, 19 nt, Artificial Sequence
  Description of Artificial Sequence: Synthetic oligonucleotide
ggagauacaguuauucagu

SEQ ID NO: 692 - RNA, 19 nt, Artificial Sequence
  Description of Artificial Sequence: Synthetic oligonucleotide
cggucauuccccgccacca

SEQ ID NO: 693 - RNA, 19 nt, Artificial Sequence
  Description of Artificial Sequence: Synthetic oligonucleotide
acggucauuccccgccacc

SEQ ID NO: 694 - RNA, 19 nt, Artificial Sequence
  Description of Artificial Sequence: Synthetic oligonucleotide
cacggucauuccccgccac

SEQ ID NO: 695 - RNA, 19 nt, Artificial Sequence
  Description of Artificial Sequence: Synthetic oligonucleotide
acacggucauuccccgcca

SEQ ID NO: 696 - RNA, 19 nt, Artificial Sequence
  Description of Artificial Sequence: Synthetic oligonucleotide
ccgcugcagcaacucacuu

SEQ ID NO: 697 - RNA, 19 nt, Artificial Sequence
  Description of Artificial Sequence: Synthetic oligonucleotide
gaugagggccucgaugaag

SEQ ID NO: 698 - RNA, 19 nt, Artificial Sequence
  Description of Artificial Sequence: Synthetic oligonucleotide
gaguugcuuggcagucaag

SEQ ID NO: 699 - RNA, 19 nt, Artificial Sequence
  Description of Artificial Sequence: Synthetic oligonucleotide
augaguugcuuggcaguca

SEQ ID NO: 700 - RNA, 19 nt, Artificial Sequence
  Description of Artificial Sequence: Synthetic oligonucleotide
gcuuuugaugaguugcuug

SEQ ID NO: 701 - RNA, 19 nt, Artificial Sequence
  Description of Artificial Sequence: Synthetic oligonucleotide
augcuuuugaugaguugcu

SEQ ID NO: 702 - RNA, 19 nt, Artificial Sequence
  Description of Artificial Sequence: Synthetic oligonucleotide
aaugcuuuugaugaguugc

SEQ ID NO: 703 - RNA, 23 nt, Homo sapiens
  modified_base (1)..(2): a, c, u, g, unknown or other
nnaggggggcuggaccaaggggu

SEQ ID NO: 704 - RNA, 23 nt, Homo sapiens
  modified_base (1)..(1): a, c, u, g, unknown or other
naggggggcuggaccaaggggug

SEQ ID NO: 705 - RNA, 23 nt, Homo sapiens
aggggggcuggaccaaggggugg

SEQ ID NO: 706 - RNA, 23 nt, Homo sapiens
ggggggcuggaccaagggguggg

SEQ ID NO: 707 - RNA, 23 nt, Homo sapiens
gggggcuggaccaaggggugggg

SEQ ID NO: 708 - RNA, 23 nt, Homo sapiens
ggggcuggaccaaggggugggga

SEQ ID NO: 709 - RNA, 23 nt, Homo sapiens
gggcuggaccaagggguggggag

SEQ ID NO: 710 - RNA, 23 nt, Homo sapiens
ggcuggaccaagggguggggaga

SEQ ID NO: 711 - RNA, 23 nt, Homo sapiens
gcuggaccaagggguggggagaa

SEQ ID NO: 712 - RNA, 23 nt, Homo sapiens
cuggaccaagggguggggagaag

SEQ ID NO: 713 - RNA, 23 nt, Homo sapiens
uggaccaagggguggggagaagg

SEQ ID NO: 714 - RNA, 23 nt, Homo sapiens
ggaccaagggguggggagaaggg

SEQ ID NO: 715 - RNA, 23 nt, Homo sapiens
gaccaagggguggggagaagggg

SEQ ID NO: 716 - RNA, 23 nt, Homo sapiens
accaagggguggggagaagggga

SEQ ID NO: 717 - RNA, 23 nt, Homo sapiens
ccaagggguggggagaaggggag

SEQ ID NO: 718 - RNA, 23 nt, Homo sapiens
caagggguggggagaaggggagg

SEQ ID NO: 719 - RNA, 23 nt, Homo sapiens
aagggguggggagaaggggagga

SEQ ID NO: 720 - RNA, 23 nt, Homo sapiens
agggguggggagaaggggaggag

SEQ ID NO: 721 - RNA, 23 nt, Homo sapiens
gggguggggagaaggggaggagg

SEQ ID NO: 722 - RNA, 23 nt, Homo sapiens
ggguggggagaaggggaggaggc

SEQ ID NO: 723 - RNA, 23 nt, Homo sapiens
gguggggagaaggggaggaggcc

SEQ ID NO: 724 - RNA, 23 nt, Homo sapiens
guggggagaaggggaggaggccu

SEQ ID NO: 725 - RNA, 23 nt, Homo sapiens
uggggagaaggggaggaggccuc

SEQ ID NO: 726 - RNA, 23 nt, Homo sapiens
ggggagaaggggaggaggccucg

SEQ ID NO: 727 - RNA, 23 nt, Homo sapiens
gggagaaggggaggaggccucgg

SEQ ID NO: 728 - RNA, 23 nt, Homo sapiens
ggagaaggggaggaggccucggc

SEQ ID NO: 729 - RNA, 23 nt, Homo sapiens
gagaaggggaggaggccucggcc

SEQ ID NO: 730 - RNA, 23 nt, Homo sapiens
agaaggggaggaggccucggccg

SEQ ID NO: 731 - RNA, 23 nt, Homo sapiens
gaaggggaggaggccucggccgg

SEQ ID NO: 732 - RNA, 23 nt, Homo sapiens
aaggggaggaggccucggccggc

SEQ ID NO: 733 - RNA, 23 nt, Homo sapiens
aggggaggaggccucggccggcc

SEQ ID NO: 734 - RNA, 23 nt, Homo sapiens
ggggaggaggccucggccggccg

SEQ ID NO: 735 - RNA, 23 nt, Homo sapiens
gggaggaggccucggccggccgc

SEQ ID NO: 736 - RNA, 23 nt, Homo sapiens
ggaggaggccucggccggccgca

SEQ ID NO: 737 - RNA, 23 nt, Homo sapiens
gaggaggccucggccggccgcag

SEQ ID NO: 738 - RNA, 23 nt, Homo sapiens
aggaggccucggccggccgcaga

SEQ ID NO: 739 - RNA, 23 nt, Homo sapiens
ggaggccucggccggccgcagag

SEQ ID NO: 740 - RNA, 23 nt, Homo sapiens
gaggccucggccggccgcagaga

SEQ ID NO: 741 - RNA, 23 nt, Homo sapiens
aggccucggccggccgcagagag

SEQ ID NO: 742 - RNA, 23 nt, Homo sapiens
ggccucggccggccgcagagaga

SEQ ID NO: 743 - RNA, 23 nt, Homo sapiens
gccucggccggccgcagagagaa

SEQ ID NO: 744 - RNA, 23 nt, Homo sapiens
ccucggccggccgcagagagaag

SEQ ID NO: 745 - RNA, 23 nt, Homo sapiens
cucggccggccgcagagagaagu

SEQ ID NO: 746 - RNA, 23 nt, Homo sapiens
ucggccggccgcagagagaagug

SEQ ID NO: 747 - RNA, 23 nt, Homo sapiens
cggccggccgcagagagaagugg

SEQ ID NO: 748 - RNA, 23 nt, Homo sapiens
ggccggccgcagagagaaguggc

SEQ ID NO: 749 - RNA, 23 nt, Homo sapiens
gccggccgcagagagaaguggcc

SEQ ID NO: 750 - RNA, 23 nt, Homo sapiens
ccggccgcagagagaaguggcca

SEQ ID NO: 751 - RNA, 23 nt, Homo sapiens
cggccgcagagagaaguggccag

SEQ ID NO: 752 - RNA, 23 nt, Homo sapiens
ggccgcagagagaaguggccaga

SEQ ID NO: 753 - RNA, 23 nt, Homo sapiens
gccgcagagagaaguggccagag

SEQ ID NO: 754 - RNA, 23 nt, Homo sapiens
ccgcagagagaaguggccagaga

SEQ ID NO: 755 - RNA, 23 nt, Homo sapiens
cgcagagagaaguggccagagag

SEQ ID NO: 756 - RNA, 23 nt, Homo sapiens
gcagagagaaguggccagagagg

SEQ ID NO: 757 - RNA, 23 nt, Homo sapiens
cagagagaaguggccagagaggc

SEQ ID NO: 758 - RNA, 23 nt, Homo sapiens
agagagaaguggccagagaggcc

SEQ ID NO: 759 - RNA, 23 nt, Homo sapiens
gagagaaguggccagagaggccc

SEQ ID NO: 760 - RNA, 23 nt, Homo sapiens
agagaaguggccagagaggccca

SEQ ID NO: 761 - RNA, 23 nt, Homo sapiens
gagaaguggccagagaggcccag

SEQ ID NO: 762 - RNA, 23 nt, Homo sapiens
agaaguggccagagaggcccagg

SEQ ID NO: 763 - RNA, 23 nt, Homo sapiens
gaaguggccagagaggcccaggg

SEQ ID NO: 764 - RNA, 23 nt, Homo sapiens
aaguggccagagaggcccagggg

SEQ ID NO: 765 - RNA, 23 nt, Homo sapiens
aguggccagagaggcccagggga

SEQ ID NO: 766 - RNA, 23 nt, Homo sapiens
guggccagagaggcccaggggac

SEQ ID NO: 767 - RNA, 23 nt, Homo sapiens
uggccagagaggcccaggggaca

SEQ ID NO: 768 - RNA, 23 nt, Homo sapiens
ggccagagaggcccaggggacag

SEQ ID NO: 769 - RNA, 23 nt, Homo sapiens
gccagagaggcccaggggacagc

SEQ ID NO: 770 - RNA, 23 nt, Homo sapiens
ccagagaggcccaggggacagcc

SEQ ID NO: 771 - RNA, 23 nt, Homo sapiens
cagagaggcccaggggacagcca

SEQ ID NO: 772 - RNA, 23 nt, Homo sapiens
agagaggcccaggggacagccag

SEQ ID NO: 773 - RNA, 23 nt, Homo sapiens
gagaggcccaggggacagccagg

SEQ ID NO: 774 - RNA, 23 nt, Homo sapiens
agaggcccaggggacagccaggg

SEQ ID NO: 775 - RNA, 23 nt, Homo sapiens
gaggcccaggggacagccaggga

SEQ ID NO: 776 - RNA, 23 nt, Homo sapiens
aggcccaggggacagccagggac

SEQ ID NO: 777 - RNA, 23 nt, Homo sapiens
ggcccaggggacagccagggaca

SEQ ID NO: 778 - RNA, 23 nt, Homo sapiens
gcccaggggacagccagggacag

SEQ ID NO: 779 - RNA, 23 nt, Homo sapiens
cccaggggacagccagggacagg

SEQ ID NO: 780 - RNA, 23 nt, Homo sapiens
ccaggggacagccagggacaggc

SEQ ID NO: 781 - RNA, 23 nt, Homo sapiens
caggggacagccagggacaggca

SEQ ID NO: 782 - RNA, 23 nt, Homo sapiens
aggggacagccagggacaggcag

SEQ ID NO: 783 - RNA, 23 nt, Homo sapiens
ggggacagccagggacaggcaga

SEQ ID NO: 784 - RNA, 23 nt, Homo sapiens
gggacagccagggacaggcagac

SEQ ID NO: 785 - RNA, 23 nt, Homo sapiens
ggacagccagggacaggcagaca

SEQ ID NO: 786 - RNA, 23 nt, Homo sapiens
gacagccagggacaggcagacau

SEQ ID NO: 787 - RNA, 23 nt, Homo sapiens
acagccagggacaggcagacaug

SEQ ID NO: 788 - RNA, 23 nt, Homo sapiens
cagccagggacaggcagacaugc

SEQ ID NO: 789 - RNA, 23 nt, Homo sapiens
agccagggacaggcagacaugca

SEQ ID NO: 790 - RNA, 23 nt, Homo sapiens
gccagggacaggcagacaugcag

SEQ ID NO: 791 - RNA, 23 nt, Homo sapiens
ccagggacaggcagacaugcagc

SEQ ID NO: 792 - RNA, 23 nt, Homo sapiens
cagggacaggcagacaugcagcc

SEQ ID NO: 793 - RNA, 23 nt, Homo sapiens
agggacaggcagacaugcagcca

SEQ ID NO: 794 - RNA, 23 nt, Homo sapiens
gggacaggcagacaugcagccag

SEQ ID NO: 795 - RNA, 23 nt, Homo sapiens
ggacaggcagacaugcagccagg

SEQ ID NO: 796 - RNA, 23 nt, Homo sapiens
gacaggcagacaugcagccaggg

SEQ ID NO: 797 - RNA, 23 nt, Homo sapiens
acaggcagacaugcagccagggc

SEQ ID NO: 798 - RNA, 23 nt, Homo sapiens
caggcagacaugcagccagggcu

SEQ ID NO: 799 - RNA, 23 nt, Homo sapiens
aggcagacaugcagccagggcuc

SEQ ID NO: 800 - RNA, 23 nt, Homo sapiens
ggcagacaugcagccagggcucc

SEQ ID NO: 801 - RNA, 23 nt, Homo sapiens
gcagacaugcagccagggcucca

SEQ ID NO: 802 - RNA, 23 nt, Homo sapiens
cagacaugcagccagggcuccag

SEQ ID NO: 803 - RNA, 23 nt, Homo sapiens
agacaugcagccagggcuccagg

SEQ ID NO: 804 - RNA, 23 nt, Homo sapiens
gacaugcagccagggcuccaggg

SEQ ID NO: 805 - RNA, 23 nt, Homo sapiens
acaugcagccagggcuccagggc

SEQ ID NO: 806 - RNA, 23 nt, Homo sapiens
caugcagccagggcuccagggcc

SEQ ID NO: 807 - RNA, 23 nt, Homo sapiens
augcagccagggcuccagggccu

SEQ ID NO: 808 - RNA, 23 nt, Homo sapiens
ugcagccagggcuccagggccug

SEQ ID NO: 809 - RNA, 23 nt, Homo sapiens
gcagccagggcuccagggccugg

SEQ ID NO: 810 - RNA, 23 nt, Homo sapiens
cagccagggcuccagggccugga

SEQ ID NO: 811 - RNA, 23 nt, Homo sapiens
agccagggcuccagggccuggac

SEQ ID NO: 812 - RNA, 23 nt, Homo sapiens
gccagggcuccagggccuggaca

SEQ ID NO: 813 - RNA, 23 nt, Homo sapiens
ccagggcuccagggccuggacag

SEQ ID NO: 814 - RNA, 23 nt, Homo sapiens
cagggcuccagggccuggacagg

SEQ ID NO: 815 - RNA, 23 nt, Homo sapiens
agggcuccagggccuggacaggg

SEQ ID NO: 816 - RNA, 23 nt, Homo sapiens
gggcuccagggccuggacagggg

SEQ ID NO: 817 - RNA, 23 nt, Homo sapiens
ggcuccagggccuggacaggggc

SEQ ID NO: 818 - RNA, 23 nt, Homo sapiens
gcuccagggccuggacaggggcu

SEQ ID NO: 819 - RNA, 23 nt, Homo sapiens
cuccagggccuggacaggggcug

SEQ ID NO: 820 - RNA, 23 nt, Homo sapiens
uccagggccuggacaggggcugc

SEQ ID NO: 821 - RNA, 23 nt, Homo sapiens
ccagggccuggacaggggcugcc

SEQ ID NO: 822 - RNA, 23 nt, Homo sapiens
cagggccuggacaggggcugcca

SEQ ID NO: 823 - RNA, 23 nt, Homo sapiens
agggccuggacaggggcugccag

SEQ ID NO: 824 - RNA, 23 nt, Homo sapiens
gggccuggacaggggcugccagg

SEQ ID NO: 825 - RNA, 23 nt, Homo sapiens
ggccuggacaggggcugccaggc

SEQ ID NO: 826 - RNA, 23 nt, Homo sapiens
gccuggacaggggcugccaggcc

SEQ ID NO: 827 - RNA, 23 nt, Homo sapiens
ccuggacaggggcugccaggccc

SEQ ID NO: 828 - RNA, 23 nt, Homo sapiens
cuggacaggggcugccaggcccu

SEQ ID NO: 829 - RNA, 23 nt, Homo sapiens
uggacaggggcugccaggcccug

SEQ ID NO: 830 - RNA, 23 nt, Homo sapiens
ggacaggggcugccaggcccugu

SEQ ID NO: 831 - RNA, 23 nt, Homo sapiens
gacaggggcugccaggcccugug

SEQ ID NO: 832 - RNA, 23 nt, Homo sapiens
acaggggcugccaggcccuguga

SEQ ID NO: 833 - RNA, 23 nt, Homo sapiens
caggggcugccaggcccugugac

SEQ ID NO: 834 - RNA, 23 nt, Homo sapiens
aggggcugccaggcccugugaca

SEQ ID NO: 835 - RNA, 23 nt, Homo sapiens
ggggcugccaggcccugugacag

SEQ ID NO: 836 - RNA, 23 nt, Homo sapiens
gggcugccaggcccugugacagg

SEQ ID NO: 837 - RNA, 23 nt, Homo sapiens
ggcugccaggcccugugacagga

SEQ ID NO: 838 - RNA, 23 nt, Homo sapiens
gcugccaggcccugugacaggag

SEQ ID NO: 839 - RNA, 23 nt, Homo sapiens
cugccaggcccugugacaggagg

SEQ ID NO: 840 - RNA, 23 nt, Homo sapiens
ugccaggcccugugacaggagga

SEQ ID NO: 841 - RNA, 23 nt, Homo sapiens
gccaggcccugugacaggaggac

SEQ ID NO: 842 - RNA, 23 nt, Homo sapiens
ccaggcccugugacaggaggacc

SEQ ID NO: 843 - RNA, 23 nt, Homo sapiens
caggcccugugacaggaggaccc

SEQ ID NO: 844 - RNA, 23 nt, Homo sapiens
aggcccugugacaggaggacccc

SEQ ID NO: 845 - RNA, 23 nt, Homo sapiens
ggcccugugacaggaggaccccg

SEQ ID NO: 846 - RNA, 23 nt, Homo sapiens
gcccugugacaggaggaccccga

SEQ ID NO: 847 - RNA, 23 nt, Homo sapiens
cccugugacaggaggaccccgag

SEQ ID NO: 848 - RNA, 23 nt, Homo sapiens
ccugugacaggaggaccccgagc

SEQ ID NO: 849 - RNA, 23 nt, Homo sapiens
cugugacaggaggaccccgagcc

SEQ ID NO: 850 - RNA, 23 nt, Homo sapiens
ugugacaggaggaccccgagccc

SEQ ID NO: 851 - RNA, 23 nt, Homo sapiens
gugacaggaggaccccgagcccc

SEQ ID NO: 852 - RNA, 23 nt, Homo sapiens
ugacaggaggaccccgagccccc

SEQ ID NO: 853 - RNA, 23 nt, Homo sapiens
gacaggaggaccccgagcccccg

SEQ ID NO: 854 - RNA, 23 nt, Homo sapiens
acaggaggaccccgagcccccgg

SEQ ID NO: 855 - RNA, 23 nt, Homo sapiens
caggaggaccccgagcccccggc

SEQ ID NO: 856 - RNA, 23 nt, Homo sapiens
aggaggaccccgagcccccggcc

SEQ ID NO: 857 - RNA, 23 nt, Homo sapiens
ggaggaccccgagcccccggccc

SEQ ID NO: 858 - RNA, 23 nt, Homo sapiens
gaggaccccgagcccccggcccg

SEQ ID NO: 859 - RNA, 23 nt, Homo sapiens
aggaccccgagcccccggcccgg

SEQ ID NO: 860 - RNA, 23 nt, Homo sapiens
ggaccccgagcccccggcccggg

SEQ ID NO: 861 - RNA, 23 nt, Homo sapiens
gaccccgagcccccggcccgggg

SEQ ID NO: 862 - RNA, 23 nt, Homo sapiens
accccgagcccccggcccgggga

SEQ ID NO: 863 - RNA, 23 nt, Homo sapiens
ccccgagcccccggcccggggag

SEQ ID NO: 864 - RNA, 23 nt, Homo sapiens
cccgagcccccggcccggggagg

SEQ ID NO: 865 - RNA, 23 nt, Homo sapiens
ccgagcccccggcccggggaggg

SEQ ID NO: 866 - RNA, 23 nt, Homo sapiens
cgagcccccggcccggggagggg

SEQ ID NO: 867 - RNA, 23 nt, Homo sapiens
gagcccccggcccggggaggggc

SEQ ID NO: 868 - RNA, 23 nt, Homo sapiens
agcccccggcccggggaggggcc

SEQ ID NO: 869 - RNA, 23 nt, Homo sapiens
gcccccggcccggggaggggcca

SEQ ID NO: 870 - RNA, 23 nt, Homo sapiens
cccccggcccggggaggggccau

SEQ ID NO: 871 - RNA, 23 nt, Homo sapiens
ccccggcccggggaggggccaug

SEQ ID NO: 872 - RNA, 23 nt, Homo sapiens
cccggcccggggaggggccaugg

SEQ ID NO: 873 - RNA, 23 nt, Homo sapiens
ccggcccggggaggggccauggu

SEQ ID NO: 874 - RNA, 23 nt, Homo sapiens
cggcccggggaggggccauggug

SEQ ID NO: 875 - RNA, 23 nt, Homo sapiens
ggcccggggaggggccauggugc

SEQ ID NO: 876 - RNA, 23 nt, Homo sapiens
gcccggggaggggccauggugcu

SEQ ID NO: 877 - RNA, 23 nt, Homo sapiens
cccggggaggggccauggugcug

SEQ ID NO: 878 - RNA, 23 nt, Homo sapiens
ccggggaggggccauggugcugc

SEQ ID NO: 879 - RNA, 23 nt, Homo sapiens
cggggaggggccauggugcugcc

SEQ ID NO: 880 - RNA, 23 nt, Homo sapiens
ggggaggggccauggugcugccu

SEQ ID NO: 881 - RNA, 23 nt, Homo sapiens
gggaggggccauggugcugccug

SEQ ID NO: 882 - RNA, 23 nt, Homo sapiens
ggaggggccauggugcugccugu

SEQ ID NO: 883 - RNA, 23 nt, Homo sapiens
gaggggccauggugcugccuguc

SEQ ID NO: 884 - RNA, 23 nt, Homo sapiens
aggggccauggugcugccugucc

SEQ ID NO: 885 - RNA, 23 nt, Homo sapiens
ggggccauggugcugccugucca

SEQ ID NO: 886 - RNA, 23 nt, Homo sapiens
gggccauggugcugccuguccaa

SEQ ID NO: 887 - RNA, 23 nt, Homo sapiens
ggccauggugcugccuguccaac

SEQ ID NO: 888 - RNA, 23 nt, Homo sapiens
gccauggugcugccuguccaaca

SEQ ID NO: 889 - RNA, 23 nt, Homo sapiens
ccauggugcugccuguccaacau

SEQ ID NO: 890 - RNA, 23 nt, Homo sapiens
cauggugcugccuguccaacaug

SEQ ID NO: 891 - RNA, 23 nt, Homo sapiens
auggugcugccuguccaacaugu

SEQ ID NO: 892 - RNA, 23 nt, Homo sapiens
uggugcugccuguccaacauguc

SEQ ID NO: 893 - RNA, 23 nt, Homo sapiens
ggugcugccuguccaacauguca

SEQ ID NO: 894 - RNA, 23 nt, Homo sapiens
gugcugccuguccaacaugucag

SEQ ID NO: 895 - RNA, 23 nt, Homo sapiens
ugcugccuguccaacaugucagc

SEQ ID NO: 896 - RNA, 23 nt, Homo sapiens
gcugccuguccaacaugucagcc

SEQ ID NO: 897 - RNA, 23 nt, Homo sapiens
cugccuguccaacaugucagccg

SEQ ID NO: 898 - RNA, 23 nt, Homo sapiens
ugccuguccaacaugucagccga

SEQ ID NO: 899 - RNA, 23 nt, Homo sapiens
gccuguccaacaugucagccgag

SEQ ID NO: 900 - RNA, 23 nt, Homo sapiens
ccuguccaacaugucagccgagg

SEQ ID NO: 901 - RNA, 23 nt, Homo sapiens
cuguccaacaugucagccgaggu

SEQ ID NO: 902 - RNA, 23 nt, Homo sapiens
uguccaacaugucagccgaggug

SEQ ID NO: 903 - RNA, 23 nt, Homo sapiens
guccaacaugucagccgaggugc

SEQ ID NO: 904 - RNA, 23 nt, Homo sapiens
uccaacaugucagccgaggugcg

SEQ ID NO: 905 - RNA, 23 nt, Homo sapiens
ccaacaugucagccgaggugcgg

SEQ ID NO: 906 - RNA, 23 nt, Homo sapiens
caacaugucagccgaggugcggc

SEQ ID NO: 907 - RNA, 23 nt, Homo sapiens
aacaugucagccgaggugcggcu

SEQ ID NO: 908 - RNA, 23 nt, Homo sapiens
acaugucagccgaggugcggcug

SEQ ID NO: 909 - RNA, 23 nt, Homo sapiens
caugucagccgaggugcggcuga

SEQ ID NO: 910 - RNA, 23 nt, Homo sapiens
augucagccgaggugcggcugag

SEQ ID NO: 911 - RNA, 23 nt, Homo sapiens
ugucagccgaggugcggcugagg

SEQ ID NO: 912 - RNA, 23 nt, Homo sapiens
gucagccgaggugcggcugaggc

SEQ ID NO: 913 - RNA, 23 nt, Homo sapiens
ucagccgaggugcggcugaggcg

SEQ ID NO: 914 - RNA, 23 nt, Homo sapiens
cagccgaggugcggcugaggcgg

SEQ ID NO: 915 - RNA, 23 nt, Homo sapiens
agccgaggugcggcugaggcggc

SEQ ID NO: 916 - RNA, 23 nt, Homo sapiens
gccgaggugcggcugaggcggcu

SEQ ID NO: 917 - RNA, 23 nt, Homo sapiens
ccgaggugcggcugaggcggcuc

SEQ ID NO: 918 - RNA, 23 nt, Homo sapiens
cgaggugcggcugaggcggcucc

SEQ ID NO: 919 - RNA, 23 nt, Homo sapiens
gaggugcggcugaggcggcucca

SEQ ID NO: 920 - RNA, 23 nt, Homo sapiens
aggugcggcugaggcggcuccag

SEQ ID NO: 921 - RNA, 23 nt, Homo sapiens
ggugcggcugaggcggcuccagc

SEQ ID NO: 922 - RNA, 23 nt, Homo sapiens
gugcggcugaggcggcuccagca

SEQ ID NO: 923 - RNA, 23 nt, Homo sapiens
ugcggcugaggcggcuccagcag

SEQ ID NO: 924 - RNA, 23 nt, Homo sapiens
gcggcugaggcggcuccagcagc

SEQ ID NO: 925 - RNA, 23 nt, Homo sapiens
cggcugaggcggcuccagcagcu

SEQ ID NO: 926 - RNA, 23 nt, Homo sapiens
ggcugaggcggcuccagcagcug

SEQ ID NO: 927 - RNA, 23 nt, Homo sapiens
gcugaggcggcuccagcagcugg

SEQ ID NO: 928 - RNA, 23 nt, Homo sapiens
cugaggcggcuccagcagcuggu

SEQ ID NO: 929 - RNA, 23 nt, Homo sapiens
ugaggcggcuccagcagcuggug

SEQ ID NO: 930 - RNA, 23 nt, Homo sapiens
gaggcggcuccagcagcuggugu

SEQ ID NO: 931 - RNA, 23 nt, Homo sapiens
aggcggcuccagcagcugguguu

SEQ ID NO: 932 - RNA, 23 nt, Homo sapiens
ggcggcuccagcagcugguguug

SEQ ID NO: 933 - RNA, 23 nt, Homo sapiens
gcggcuccagcagcugguguugg

SEQ ID NO: 934 - RNA, 23 nt, Homo sapiens
cggcuccagcagcugguguugga

SEQ ID NO: 935 - RNA, 23 nt, Homo sapiens
ggcuccagcagcugguguuggac

SEQ ID NO: 936 - RNA, 23 nt, Homo sapiens
gcuccagcagcugguguuggacc

SEQ ID NO: 937 - RNA, 23 nt, Homo sapiens
cuccagcagcugguguuggaccc

SEQ ID NO: 938 - RNA, 23 nt, Homo sapiens
uccagcagcugguguuggacccg

SEQ ID NO: 939 - RNA, 23 nt, Homo sapiens
ccagcagcugguguuggacccgg

SEQ ID NO: 940 - RNA, 23 nt, Homo sapiens
cagcagcugguguuggacccggg

SEQ ID NO: 941 - RNA, 23 nt, Homo sapiens
agcagcugguguuggacccgggc

SEQ ID NO: 942 - RNA, 23 nt, Homo sapiens
gcagcugguguuggacccgggcu

SEQ ID NO: 943 - RNA, 23 nt, Homo sapiens
cagcugguguuggacccgggcuu

SEQ ID NO: 944 - RNA, 23 nt, Homo sapiens
agcugguguuggacccgggcuuc

SEQ ID NO: 945 - RNA, 23 nt, Homo sapiens
gcugguguuggacccgggcuucc

SEQ ID NO: 946 - RNA, 23 nt, Homo sapiens
cugguguuggacccgggcuuccu

SEQ ID NO: 947 - RNA, 23 nt, Homo sapiens
ugguguuggacccgggcuuccug

SEQ ID NO: 948 - RNA, 23 nt, Homo sapiens
gguguuggacccgggcuuccugg

SEQ ID NO: 949 - RNA, 23 nt, Homo sapiens
guguuggacccgggcuuccuggg

SEQ ID NO: 950 - RNA, 23 nt, Homo sapiens
uguuggacccgggcuuccugggg

SEQ ID NO: 951 - RNA, 23 nt, Homo sapiens
guuggacccgggcuuccuggggc

SEQ ID NO: 952 - RNA, 23 nt, Homo sapiens
uuggacccgggcuuccuggggcu

SEQ ID NO: 953 - RNA, 23 nt, Homo sapiens
uggacccgggcuuccuggggcug

SEQ ID NO: 954 - RNA, 23 nt, Homo sapiens
ggacccgggcuuccuggggcugg

SEQ ID NO: 955 - RNA, 23 nt, Homo sapiens
gacccgggcuuccuggggcugga

SEQ ID NO: 956 - RNA, 23 nt, Homo sapiens
acccgggcuuccuggggcuggag

SEQ ID NO: 957 - RNA, 23 nt, Homo sapiens
cccgggcuuccuggggcuggagc

SEQ ID NO: 958 - RNA, 23 nt, Homo sapiens
ccgggcuuccuggggcuggagcc

SEQ ID NO: 959 - RNA, 23 nt, Homo sapiens
cgggcuuccuggggcuggagccc

SEQ ID NO: 960 - RNA, 23 nt, Homo sapiens
gggcuuccuggggcuggagcccc

SEQ ID NO: 961 - RNA, 23 nt, Homo sapiens
ggcuuccuggggcuggagccccu

SEQ ID NO: 962 - RNA, 23 nt, Homo sapiens
gcuuccuggggcuggagccccug

SEQ ID NO: 963 - RNA, 23 nt, Homo sapiens
cuuccuggggcuggagccccugc

SEQ ID NO: 964 - RNA, 23 nt, Homo sapiens
uuccuggggcuggagccccugcu

SEQ ID NO: 965 - RNA, 23 nt, Homo sapiens
uccuggggcuggagccccugcuc

SEQ ID NO: 966 - RNA, 23 nt, Homo sapiens
ccuggggcuggagccccugcucg

SEQ ID NO: 967 - RNA, 23 nt, Homo sapiens
cuggggcuggagccccugcucga

SEQ ID NO: 968 - RNA, 23 nt, Homo sapiens
uggggcuggagccccugcucgac

SEQ ID NO: 969 - RNA, 23 nt, Homo sapiens
ggggcuggagccccugcucgacc

SEQ ID NO: 970 - RNA, 23 nt, Homo sapiens
gggcuggagccccugcucgaccu

SEQ ID NO: 971 - RNA, 23 nt, Homo sapiens
ggcuggagccccugcucgaccuu

SEQ ID NO: 972 - RNA, 23 nt, Homo sapiens
gcuggagccccugcucgaccuuc

SEQ ID NO: 973 - RNA, 23 nt, Homo sapiens
cuggagccccugcucgaccuucu

SEQ ID NO: 974 - RNA, 23 nt, Homo sapiens
uggagccccugcucgaccuucuc

SEQ ID NO: 975 - RNA, 23 nt, Homo sapiens
ggagccccugcucgaccuucucc

SEQ ID NO: 976 - RNA, 23 nt, Homo sapiens
gagccccugcucgaccuucuccu

SEQ ID NO: 977 - RNA, 23 nt, Homo sapiens
agccccugcucgaccuucuccug

SEQ ID NO: 978 - RNA, 23 nt, Homo sapiens
gccccugcucgaccuucuccugg

SEQ ID NO: 979 - RNA, 23 nt, Homo sapiens
ccccugcucgaccuucuccuggg

SEQ ID NO: 980 - RNA, 23 nt, Homo sapiens
cccugcucgaccuucuccugggc

SEQ ID NO: 981 - RNA, 23 nt, Homo sapiens
ccugcucgaccuucuccugggcg

SEQ ID NO: 982 - RNA, 23 nt, Homo sapiens
cugcucgaccuucuccugggcgu

SEQ ID NO: 983 - RNA, 23 nt, Homo sapiens
ugcucgaccuucuccugggcguc

SEQ ID NO: 984 - RNA, 23 nt, Homo sapiens
gcucgaccuucuccugggcgucc

SEQ ID NO: 985 - RNA, 23 nt, Homo sapiens
cucgaccuucuccugggcgucca

SEQ ID NO: 986 - RNA, 23 nt, Homo sapiens
ucgaccuucuccugggcguccac

SEQ ID NO: 987 - RNA, 23 nt, Homo sapiens
cgaccuucuccugggcguccacc

SEQ ID NO: 988 - RNA, 23 nt, Homo sapiens
gaccuucuccugggcguccacca

SEQ ID NO: 989 - RNA, 23 nt, Homo sapiens
accuucuccugggcguccaccag

SEQ ID NO: 990 - RNA, 23 nt, Homo sapiens
ccuucuccugggcguccaccagg

SEQ ID NO: 991 - RNA, 23 nt, Homo sapiens
cuucuccugggcguccaccagga

SEQ ID NO: 992 - RNA, 23 nt, Homo sapiens
uucuccugggcguccaccaggag

SEQ ID NO: 993 - RNA, 23 nt, Homo sapiens
ucuccugggcguccaccaggagc

SEQ ID NO: 994 - RNA, 23 nt, Homo sapiens
cuccugggcguccaccaggagcu

SEQ ID NO: 995 - RNA, 23 nt, Homo sapiens
uccugggcguccaccaggagcug

SEQ ID NO: 996 - RNA, 23 nt, Homo sapiens
ccugggcguccaccaggagcugg

SEQ ID NO: 997 - RNA, 23 nt, Homo sapiens
cugggcguccaccaggagcuggg

SEQ ID NO: 998 - RNA, 23 nt, Homo sapiens
ugggcguccaccaggagcugggc

SEQ ID NO: 999 - RNA, 23 nt, Homo sapiens
gggcguccaccaggagcugggcg

SEQ ID NO: 1000 - RNA, 23 nt, Homo sapiens
ggcguccaccaggagcugggcgc

SEQ ID NO: 1001 - RNA, 23 nt, Homo sapiens
gcguccaccaggagcugggcgcc

SEQ ID NO: 1002 - RNA, 23 nt, Homo sapiens
cguccaccaggagcugggcgccu

SEQ ID NO: 1003 - RNA, 23 nt, Homo sapiens
guccaccaggagcugggcgccuc

SEQ ID NO: 1004 - RNA, 23 nt, Homo sapiens
uccaccaggagcugggcgccucc

SEQ ID NO: 1005 - RNA, 23 nt, Homo sapiens
ccaccaggagcugggcgccuccg

SEQ ID NO: 1006 - RNA, 23 nt, Homo sapiens
caccaggagcugggcgccuccga

SEQ ID NO: 1007 - RNA, 23 nt, Homo sapiens
accaggagcugggcgccuccgaa

SEQ ID NO: 1008 - RNA, 23 nt, Homo sapiens
ccaggagcugggcgccuccgaac

SEQ ID NO: 1009 - RNA, 23 nt, Homo sapiens
caggagcugggcgccuccgaacu

SEQ ID NO: 1010 - RNA, 23 nt, Homo sapiens
aggagcugggcgccuccgaacug

SEQ ID NO: 1011 - RNA, 23 nt, Homo sapiens
ggagcugggcgccuccgaacugg

SEQ ID NO: 1012 - RNA, 23 nt, Homo sapiens
gagcugggcgccuccgaacuggc

SEQ ID NO: 1013 - RNA, 23 nt, Homo sapiens
agcugggcgccuccgaacuggcc

SEQ ID NO: 1014 - RNA, 23 nt, Homo sapiens
gcugggcgccuccgaacuggccc

SEQ ID NO: 1015 - RNA, 23 nt, Homo sapiens
cugggcgccuccgaacuggccca

SEQ ID NO: 1016 - RNA, 23 nt, Homo sapiens
ugggcgccuccgaacuggcccag

SEQ ID NO: 1017 - RNA, 23 nt, Homo sapiens
gggcgccuccgaacuggcccagg

SEQ ID NO: 1018 - RNA, 23 nt, Homo sapiens
ggcgccuccgaacuggcccagga

SEQ ID NO: 1019 - RNA, 23 nt, Homo sapiens
gcgccuccgaacuggcccaggac

SEQ ID NO: 1020 - RNA, 23 nt, Homo sapiens
cgccuccgaacuggcccaggaca

SEQ ID NO: 1021 - RNA, 23 nt, Homo sapiens
gccuccgaacuggcccaggacaa

SEQ ID NO: 1022 - RNA, 23 nt, Homo sapiens
ccuccgaacuggcccaggacaag

SEQ ID NO: 1023 - RNA, 23 nt, Homo sapiens
cuccgaacuggcccaggacaagu

SEQ ID NO: 1024 - RNA, 23 nt, Homo sapiens
uccgaacuggcccaggacaagua

SEQ ID NO: 1025 - RNA, 23 nt, Homo sapiens
ccgaacuggcccaggacaaguac

SEQ ID NO: 1026 - RNA, 23 nt, Homo sapiens
cgaacuggcccaggacaaguacg

SEQ ID NO: 1027 - RNA, 23 nt, Homo sapiens
gaacuggcccaggacaaguacgu

SEQ ID NO: 1028 - RNA, 23 nt, Homo sapiens
aacuggcccaggacaaguacgug

SEQ ID NO: 1029 - RNA, 23 nt, Homo sapiens
acuggcccaggacaaguacgugg

SEQ ID NO: 1030 - RNA, 23 nt, Homo sapiens
cuggcccaggacaaguacguggc

SEQ ID NO: 1031 - RNA, 23 nt, Homo sapiens
uggcccaggacaaguacguggcc

SEQ ID NO: 1032 - RNA, 23 nt, Homo sapiens
ggcccaggacaaguacguggccg

SEQ ID NO: 1033 - RNA, 23 nt, Homo sapiens
gcccaggacaaguacguggccga

SEQ ID NO: 1034 - RNA, 23 nt, Homo sapiens
cccaggacaaguacguggccgac

SEQ ID NO: 1035 - RNA, 23 nt, Homo sapiens
ccaggacaaguacguggccgacu

SEQ ID NO: 1036 - RNA, 23 nt, Homo sapiens
caggacaaguacguggccgacuu

SEQ ID NO: 1037 - RNA, 23 nt, Homo sapiens
aggacaaguacguggccgacuuc

SEQ ID NO: 1038 - RNA, 23 nt, Homo sapiens
ggacaaguacguggccgacuucu

SEQ ID NO: 1039 - RNA, 23 nt, Homo sapiens
gacaaguacguggccgacuucuu

SEQ ID NO: 1040 - RNA, 23 nt, Homo sapiens
acaaguacguggccgacuucuug

SEQ ID NO: 1041 - RNA, 23 nt, Homo sapiens
caaguacguggccgacuucuugc

SEQ ID NO: 1042 - RNA, 23 nt, Homo sapiens
aaguacguggccgacuucuugca

SEQ ID NO: 1043 - RNA, 23 nt, Homo sapiens
aguacguggccgacuucuugcag

SEQ ID NO: 1044 - RNA, 23 nt, Homo sapiens
guacguggccgacuucuugcagu

SEQ ID NO: 1045 - RNA, 23 nt, Homo sapiens
uacguggccgacuucuugcagug

SEQ ID NO: 1046 - RNA, 23 nt, Homo sapiens
acguggccgacuucuugcagugg

SEQ ID NO: 1047 - RNA, 23 nt, Homo sapiens
cguggccgacuucuugcaguggg

SEQ ID NO: 1048 - RNA, 23 nt, Homo sapiens
guggccgacuucuugcagugggc

SEQ ID NO: 1049 - RNA, 23 nt, Homo sapiens
uggccgacuucuugcagugggcg

SEQ ID NO: 1050 - RNA, 23 nt, Homo sapiens
ggccgacuucuugcagugggcgg

SEQ ID NO: 1051 - RNA, 23 nt, Homo sapiens
gccgacuucuugcagugggcgga

SEQ ID NO: 1052 - RNA, 23 nt, Homo sapiens
ccgacuucuugcagugggcggag

SEQ ID NO: 1053 - RNA, 23 nt, Homo sapiens
cgacuucuugcagugggcggagc

SEQ ID NO: 1054 - RNA, 23 nt, Homo sapiens
gacuucuugcagugggcggagcc

SEQ ID NO: 1055 - RNA, 23 nt, Homo sapiens
acuucuugcagugggcggagccc

SEQ ID NO: 1056 - RNA, 23 nt, Homo sapiens
cuucuugcagugggcggagccca

SEQ ID NO: 1057 - RNA, 23 nt, Homo sapiens
uucuugcagugggcggagcccau

SEQ ID NO: 1058 - RNA, 23 nt, Homo sapiens
ucuugcagugggcggagcccauc

SEQ ID NO: 1059 - RNA, 23 nt, Homo sapiens
cuugcagugggcggagcccaucg

SEQ ID NO: 1060 - RNA, 23 nt, Homo sapiens
uugcagugggcggagcccaucgu

SEQ ID NO: 1061 - RNA, 23 nt, Homo sapiens
ugcagugggcggagcccaucgug

SEQ ID NO: 1062 - RNA, 23 nt, Homo sapiens
gcagugggcggagcccaucgugg

SEQ ID NO: 1063 - RNA, 23 nt, Homo sapiens
cagugggcggagcccaucguggu

SEQ ID NO: 1064 - RNA, 23 nt, Homo sapiens
agugggcggagcccaucguggug

SEQ ID NO: 1065 - RNA, 23 nt, Homo sapiens
gugggcggagcccaucgugguga

SEQ ID NO: 1066 - RNA, 23 nt, Homo sapiens
ugggcggagcccaucguggugag

SEQ ID NO: 1067 - RNA, 23 nt, Homo sapiens
gggcggagcccaucguggugagg

SEQ ID NO: 1068 - RNA, 23 nt, Homo sapiens
ggcggagcccaucguggugaggc

SEQ ID NO: 1069 - RNA, 23 nt, Homo sapiens
gcggagcccaucguggugaggcu

SEQ ID NO: 1070 - RNA, 23 nt, Homo sapiens
cggagcccaucguggugaggcuu

SEQ ID NO: 1071 - RNA, 23 nt, Homo sapiens
ggagcccaucguggugaggcuua

SEQ ID NO: 1072 - RNA, 23 nt, Homo sapiens
gagcccaucguggugaggcuuaa

SEQ ID NO: 1073 - RNA, 23 nt, Homo sapiens
agcccaucguggugaggcuuaag

SEQ ID NO: 1074 - RNA, 23 nt, Homo sapiens
gcccaucguggugaggcuuaagg

SEQ ID NO: 1075 - RNA, 23 nt, Homo sapiens
cccaucguggugaggcuuaagga

SEQ ID NO: 1076 - RNA, 23 nt, Homo sapiens
ccaucguggugaggcuuaaggag

SEQ ID NO: 1077 - RNA, 23 nt, Homo sapiens
caucguggugaggcuuaaggagg

SEQ ID NO: 1078 - RNA, 23 nt, Homo sapiens
aucguggugaggcuuaaggaggu

SEQ ID NO: 1079 - RNA, 23 nt, Homo sapiens
ucguggugaggcuuaaggagguc

SEQ ID NO: 1080 - RNA, 23 nt, Homo sapiens
cguggugaggcuuaaggaggucc

SEQ ID NO: 1081 - RNA, 23 nt, Homo sapiens
guggugaggcuuaaggagguccg

SEQ ID NO: 1082 - RNA, 23 nt, Homo sapiens
uggugaggcuuaaggagguccga

SEQ ID NO: 1083 - RNA, 23 nt, Homo sapiens
ggugaggcuuaaggagguccgac

SEQ ID NO: 1084 - RNA, 23 nt, Homo sapiens
gugaggcuuaaggagguccgacu

SEQ ID NO: 1085 - RNA, 23 nt, Homo sapiens
ugaggcuuaaggagguccgacug

SEQ ID NO: 1086 - RNA, 23 nt, Homo sapiens
gaggcuuaaggagguccgacugc

SEQ ID NO: 1087 - RNA, 23 nt, Homo sapiens
aggcuuaaggagguccgacugca

SEQ ID NO: 1088 - RNA, 23 nt, Homo sapiens
ggcuuaaggagguccgacugcag

SEQ ID NO: 1089 - RNA, 23 nt, Homo sapiens
gcuuaaggagguccgacugcaga

SEQ ID NO: 1090 - RNA, 23 nt, Homo sapiens
cuuaaggagguccgacugcagag

SEQ ID NO: 1091 - RNA, 23 nt, Homo sapiens
uuaaggagguccgacugcagagg

SEQ ID NO: 1092 - RNA, 23 nt, Homo sapiens
uaaggagguccgacugcagaggg

SEQ ID NO: 1093 - RNA, 23 nt, Homo sapiens
aaggagguccgacugcagaggga

SEQ ID NO: 1094 - RNA, 23 nt, Homo sapiens
aggagguccgacugcagagggac

SEQ ID NO: 1095 - RNA, 23 nt, Homo sapiens
ggagguccgacugcagagggacg

SEQ ID NO: 1096 - RNA, 23 nt, Homo sapiens
gagguccgacugcagagggacga

SEQ ID NO: 1097 - RNA, 23 nt, Homo sapiens
agguccgacugcagagggacgac

SEQ ID NO: 1098 - RNA, 23 nt, Homo sapiens
gguccgacugcagagggacgacu

SEQ ID NO: 1099 - RNA, 23 nt, Homo sapiens
guccgacugcagagggacgacuu

SEQ ID NO: 1100 - RNA, 23 nt, Homo sapiens
uccgacugcagagggacgacuuc

SEQ ID NO: 1101 - RNA, 23 nt, Homo sapiens
ccgacugcagagggacgacuucg

SEQ ID NO: 1102 - RNA, 23 nt, Homo sapiens
cgacugcagagggacgacuucga

SEQ ID NO: 1103 - RNA, 23 nt, Homo sapiens
gacugcagagggacgacuucgag

SEQ ID NO: 1104 - RNA, 23 nt, Homo sapiens
acugcagagggacgacuucgaga

SEQ ID NO: 1105 - RNA, 23 nt, Homo sapiens
cugcagagggacgacuucgagau

SEQ ID NO: 1106 - RNA, 23 nt, Homo sapiens
ugcagagggacgacuucgagauu

SEQ ID NO: 1107 - RNA, 23 nt, Homo sapiens
gcagagggacgacuucgagauuc

SEQ ID NO: 1108 - RNA, 23 nt, Homo sapiens
cagagggacgacuucgagauucu

SEQ ID NO: 1109 - RNA, 23 nt, Homo sapiens
agagggacgacuucgagauucug

SEQ ID NO: 1110 - RNA, 23 nt, Homo sapiens
gagggacgacuucgagauucuga

SEQ ID NO: 1111 - RNA, 23 nt, Homo sapiens
agggacgacuucgagauucugaa

SEQ ID NO: 1112 - RNA, 23 nt, Homo sapiens
gggacgacuucgagauucugaag

SEQ ID NO: 1113 - RNA, 23 nt, Homo sapiens
ggacgacuucgagauucugaagg

SEQ ID NO: 1114 - RNA, 23 nt, Homo sapiens
gacgacuucgagauucugaaggu

SEQ ID NO: 1115 - RNA, 23 nt, Homo sapiens
acgacuucgagauucugaaggug

SEQ ID NO: 1116 - RNA, 23 nt, Homo sapiens
cgacuucgagauucugaagguga

SEQ ID NO: 1117 - RNA, 23 nt, Homo sapiens
gacuucgagauucugaaggugau

SEQ ID NO: 1118 - RNA, 23 nt, Homo sapiens
acuucgagauucugaaggugauc

SEQ ID NO: 1119 - RNA, 23 nt, Homo sapiens
cuucgagauucugaaggugaucg

SEQ ID NO: 1120 - RNA, 23 nt, Homo sapiens
uucgagauucugaaggugaucgg

SEQ ID NO: 1121 - RNA, 23 nt, Homo sapiens
ucgagauucugaaggugaucgga

SEQ ID NO: 1122 - RNA, 23 nt, Homo sapiens
cgagauucugaaggugaucggac

SEQ ID NO: 1123 - RNA, 23 nt, Homo sapiens
gagauucugaaggugaucggacg

SEQ ID NO: 1124 - RNA, 23 nt, Homo sapiens
agauucugaaggugaucggacgc

SEQ ID NO: 1125 - RNA, 23 nt, Homo sapiens
gauucugaaggugaucggacgcg

SEQ ID NO: 1126 - RNA, 23 nt, Homo sapiens
auucugaaggugaucggacgcgg

SEQ ID NO: 1127 - RNA, 23 nt, Homo sapiens
uucugaaggugaucggacgcggg

SEQ ID NO: 1128 - RNA, 23 nt, Homo sapiens
ucugaaggugaucggacgcgggg

SEQ ID NO: 1129 - RNA, 23 nt, Homo sapiens
cugaaggugaucggacgcggggc

SEQ ID NO: 1130 - RNA, 23 nt, Homo sapiens
ugaaggugaucggacgcggggcg

SEQ ID NO: 1131 - RNA, 23 nt, Homo sapiens
gaaggugaucggacgcggggcgu

SEQ ID NO: 1132 - RNA, 23 nt, Homo sapiens
aaggugaucggacgcggggcguu

SEQ ID NO: 1133 - RNA, 23 nt, Homo sapiens
aggugaucggacgcggggcguuc

SEQ ID NO: 1134 - RNA, 23 nt, Homo sapiens
ggugaucggacgcggggcguuca

SEQ ID NO: 1135 - RNA, 23 nt, Homo sapiens
gugaucggacgcggggcguucag

SEQ ID NO: 1136 - RNA, 23 nt, Homo sapiens
ugaucggacgcggggcguucagc

SEQ ID NO: 1137 - RNA, 23 nt, Homo sapiens
gaucggacgcggggcguucagcg

SEQ ID NO: 1138 - RNA, 23 nt, Homo sapiens
aucggacgcggggcguucagcga

SEQ ID NO: 1139 - RNA, 23 nt, Homo sapiens
ucggacgcggggcguucagcgag

SEQ ID NO: 1140 - RNA, 23 nt, Homo sapiens
cggacgcggggcguucagcgagg

SEQ ID NO: 1141 - RNA, 23 nt, Homo sapiens
ggacgcggggcguucagcgaggu

SEQ ID NO: 1142 - RNA, 23 nt, Homo sapiens
gacgcggggcguucagcgaggua

SEQ ID NO: 1143 - RNA, 23 nt, Homo sapiens
acgcggggcguucagcgagguag

SEQ ID NO: 1144 - RNA, 23 nt, Homo sapiens
cgcggggcguucagcgagguagc

SEQ ID NO: 1145 - RNA, 23 nt, Homo sapiens
gcggggcguucagcgagguagcg

SEQ ID NO: 1146 - RNA, 23 nt, Homo sapiens
cggggcguucagcgagguagcgg

SEQ ID NO: 1147 - RNA, 23 nt, Homo sapiens
ggggcguucagcgagguagcggu

SEQ ID NO: 1148 - RNA, 23 nt, Homo sapiens
gggcguucagcgagguagcggua

SEQ ID NO: 1149 - RNA, 23 nt, Homo sapiens
ggcguucagcgagguagcgguag

SEQ ID NO: 1150 - RNA, 23 nt, Homo sapiens
gcguucagcgagguagcgguagu

SEQ ID NO: 1151 - RNA, 23 nt, Homo sapiens
cguucagcgagguagcgguagug

SEQ ID NO: 1152 - RNA, 23 nt, Homo sapiens
guucagcgagguagcgguaguga

SEQ ID NO: 1153 - RNA, 23 nt, Homo sapiens
uucagcgagguagcgguagugaa

SEQ ID NO: 1154 - RNA, 23 nt, Homo sapiens
ucagcgagguagcgguagugaag

SEQ ID NO: 1155 - RNA, 23 nt, Homo sapiens
cagcgagguagcgguagugaaga

SEQ ID NO: 1156 - RNA, 23 nt, Homo sapiens
agcgagguagcgguagugaagau

SEQ ID NO: 1157 - RNA, 23 nt, Homo sapiens
gcgagguagcgguagugaagaug

SEQ ID NO: 1158 - RNA, 23 nt, Homo sapiens
cgagguagcgguagugaagauga

SEQ ID NO: 1159 - RNA, 23 nt, Homo sapiens
gagguagcgguagugaagaugaa

SEQ ID NO: 1160 - RNA, 23 nt, Homo sapiens
agguagcgguagugaagaugaag

SEQ ID NO: 1161 - RNA, 23 nt, Homo sapiens
gguagcgguagugaagaugaagc

SEQ ID NO: 1162 - RNA, 23 nt, Homo sapiens
guagcgguagugaagaugaagca

SEQ ID NO: 1163 - RNA, 23 nt, Homo sapiens
uagcgguagugaagaugaagcag

SEQ ID NO: 1164 - RNA, 23 nt, Homo sapiens
agcgguagugaagaugaagcaga

SEQ ID NO: 1165 - RNA, 23 nt, Homo sapiens
gcgguagugaagaugaagcagac

SEQ ID NO: 1166 - RNA, 23 nt, Homo sapiens
cgguagugaagaugaagcagacg

SEQ ID NO: 1167 - RNA, 23 nt, Homo sapiens
gguagugaagaugaagcagacgg

SEQ ID NO: 1168 - RNA, 23 nt, Homo sapiens
guagugaagaugaagcagacggg

SEQ ID NO: 1169 - RNA, 23 nt, Homo sapiens
uagugaagaugaagcagacgggc

SEQ ID NO: 1170 - RNA, 23 nt, Homo sapiens
agugaagaugaagcagacgggcc

SEQ ID NO: 1171 - RNA, 23 nt, Homo sapiens
gugaagaugaagcagacgggcca

SEQ ID NO: 1172 - RNA, 23 nt, Homo sapiens
ugaagaugaagcagacgggccag

SEQ ID NO: 1173 - RNA, 23 nt, Homo sapiens
gaagaugaagcagacgggccagg

SEQ ID NO: 1174 - RNA, 23 nt, Homo sapiens
aagaugaagcagacgggccaggu

SEQ ID NO: 1175 - RNA, 23 nt, Homo sapiens
agaugaagcagacgggccaggug

SEQ ID NO: 1176 - RNA, 23 nt, Homo sapiens
gaugaagcagacgggccaggugu

SEQ ID NO: 1177 - RNA, 23 nt, Homo sapiens
augaagcagacgggccaggugua

SEQ ID NO: 1178 - RNA, 23 nt, Homo sapiens
ugaagcagacgggccagguguau

SEQ ID NO: 1179 - RNA, 23 nt, Homo sapiens
gaagcagacgggccagguguaug

SEQ ID NO: 1180 - RNA, 23 nt, Homo sapiens
aagcagacgggccagguguaugc

SEQ ID NO: 1181 - RNA, 23 nt, Homo sapiens
agcagacgggccagguguaugcc

SEQ ID NO: 1182 - RNA, 23 nt, Homo sapiens
gcagacgggccagguguaugcca

SEQ ID NO: 1183 - RNA, 23 nt, Homo sapiens
cagacgggccagguguaugccau

SEQ ID NO: 1184 - RNA, 23 nt, Homo sapiens
agacgggccagguguaugccaug

SEQ ID NO: 1185 - RNA, 23 nt, Homo sapiens
gacgggccagguguaugccauga

SEQ ID NO: 1186 - RNA, 23 nt, Homo sapiens
acgggccagguguaugccaugaa

SEQ ID NO: 1187 - RNA, 23 nt, Homo sapiens
cgggccagguguaugccaugaag

SEQ ID NO: 1188 - RNA, 23 nt, Homo sapiens
gggccagguguaugccaugaaga

SEQ ID NO: 1189 - RNA, 23 nt, Homo sapiens
ggccagguguaugccaugaagau

SEQ ID NO: 1190 - RNA, 23 nt, Homo sapiens
gccagguguaugccaugaagauc

SEQ ID NO: 1191 - RNA, 23 nt, Homo sapiens
ccagguguaugccaugaagauca

SEQ ID NO: 1192 - RNA, 23 nt, Homo sapiens
cagguguaugccaugaagaucau

SEQ ID NO: 1193 - RNA, 23 nt, Homo sapiens
agguguaugccaugaagaucaug

SEQ ID NO: 1194 - RNA, 23 nt, Homo sapiens
gguguaugccaugaagaucauga

SEQ ID NO: 1195 - RNA, 23 nt, Homo sapiens
guguaugccaugaagaucaugaa

SEQ ID NO: 1196 - RNA, 23 nt, Homo sapiens
uguaugccaugaagaucaugaac

SEQ ID NO: 1197 - RNA, 23 nt, Homo sapiens
guaugccaugaagaucaugaaca

SEQ ID NO: 1198 - RNA, 23 nt, Homo sapiens
uaugccaugaagaucaugaacaa

SEQ ID NO: 1199 - RNA, 23 nt, Homo sapiens
augccaugaagaucaugaacaag

SEQ ID NO: 1200 - RNA, 23 nt, Homo sapiens
ugccaugaagaucaugaacaagu

SEQ ID NO: 1201 - RNA, 23 nt, Homo sapiens
gccaugaagaucaugaacaagug

SEQ ID NO: 1202 - RNA, 23 nt, Homo sapiens
ccaugaagaucaugaacaagugg

SEQ ID NO: 1203 - RNA, 23 nt, Homo sapiens
caugaagaucaugaacaaguggg

SEQ ID NO: 1204 - RNA, 23 nt, Homo sapiens
augaagaucaugaacaaguggga

SEQ ID NO: 1205 - RNA, 23 nt, Homo sapiens
ugaagaucaugaacaagugggac

SEQ ID NO: 1206 - RNA, 23 nt, Homo sapiens
gaagaucaugaacaagugggaca

SEQ ID NO: 1207 - RNA, 23 nt, Homo sapiens
aagaucaugaacaagugggacau

SEQ ID NO: 1208 - RNA, 23 nt, Homo sapiens
agaucaugaacaagugggacaug

SEQ ID NO: 1209 - RNA, 23 nt, Homo sapiens
gaucaugaacaagugggacaugc

SEQ ID NO: 1210 - RNA, 23 nt, Homo sapiens
aucaugaacaagugggacaugcu

SEQ ID NO: 1211 - RNA, 23 nt, Homo sapiens
ucaugaacaagugggacaugcug

SEQ ID NO: 1212 - RNA, 23 nt, Homo sapiens
caugaacaagugggacaugcuga

SEQ ID NO: 1213 - RNA, 23 nt, Homo sapiens
augaacaagugggacaugcugaa

SEQ ID NO: 1214 - RNA, 23 nt, Homo sapiens
ugaacaagugggacaugcugaag

SEQ ID NO: 1215 - RNA, 23 nt, Homo sapiens
gaacaagugggacaugcugaaga

SEQ ID NO: 1216 - RNA, 23 nt, Homo sapiens
aacaagugggacaugcugaagag

SEQ ID NO: 1217 - RNA, 23 nt, Homo sapiens
acaagugggacaugcugaagagg

SEQ ID NO: 1218 - RNA, 23 nt, Homo sapiens
caagugggacaugcugaagaggg

SEQ ID NO: 1219 - RNA, 23 nt, Homo sapiens
aagugggacaugcugaagagggg

SEQ ID NO: 1220 - RNA, 23 nt, Homo sapiens
agugggacaugcugaagaggggc

SEQ ID NO: 1221 - RNA, 23 nt, Homo sapiens
gugggacaugcugaagaggggcg

SEQ ID NO: 1222 - RNA, 23 nt, Homo sapiens
ugggacaugcugaagaggggcga

SEQ ID NO: 1223 - RNA, 23 nt, Homo sapiens
gggacaugcugaagaggggcgag

SEQ ID NO: 1224 - RNA, 23 nt, Homo sapiens
ggacaugcugaagaggggcgagg

SEQ ID NO: 1225 - RNA, 23 nt, Homo sapiens
gacaugcugaagaggggcgaggu

SEQ ID NO: 1226 - RNA, 23 nt, Homo sapiens
acaugcugaagaggggcgaggug

SEQ ID NO: 1227 - RNA, 23 nt, Homo sapiens
caugcugaagaggggcgaggugu

SEQ ID NO: 1228 - RNA, 23 nt, Homo sapiens
augcugaagaggggcgagguguc

SEQ ID NO: 1229 - RNA, 23 nt, Homo sapiens
ugcugaagaggggcgaggugucg

SEQ ID NO: 1230 - RNA, 23 nt, Homo sapiens
gcugaagaggggcgaggugucgu

SEQ ID NO: 1231 - RNA, 23 nt, Homo sapiens
cugaagaggggcgaggugucgug

SEQ ID NO: 1232 - RNA, 23 nt, Homo sapiens
ugaagaggggcgaggugucgugc

SEQ ID NO: 1233 - RNA, 23 nt, Homo sapiens
gaagaggggcgaggugucgugcu

SEQ ID NO: 1234 - RNA, 23 nt, Homo sapiens
aagaggggcgaggugucgugcuu

SEQ ID NO: 1235 - RNA, 23 nt, Homo sapiens
agaggggcgaggugucgugcuuc

SEQ ID NO: 1236 - RNA, 23 nt, Homo sapiens
gaggggcgaggugucgugcuucc

SEQ ID NO: 1237 - RNA, 23 nt, Homo sapiens
aggggcgaggugucgugcuuccg

SEQ ID NO: 1238 - RNA, 23 nt, Homo sapiens
ggggcgaggugucgugcuuccgu

SEQ ID NO: 1239 - RNA, 23 nt, Homo sapiens
gggcgaggugucgugcuuccgug

SEQ ID NO: 1240 - RNA, 23 nt, Homo sapiens
ggcgaggugucgugcuuccguga

SEQ ID NO: 1241 - RNA, 23 nt, Homo sapiens
gcgaggugucgugcuuccgugag

SEQ ID NO: 1242 - RNA, 23 nt, Homo sapiens
cgaggugucgugcuuccgugagg

SEQ ID NO: 1243 - RNA, 23 nt, Homo sapiens
gaggugucgugcuuccgugagga

SEQ ID NO: 1244 - RNA, 23 nt, Homo sapiens
aggugucgugcuuccgugaggag

SEQ ID NO: 1245 - RNA, 23 nt, Homo sapiens
ggugucgugcuuccgugaggaga

SEQ ID NO: 1246 - RNA, 23 nt, Homo sapiens
gugucgugcuuccgugaggagag

SEQ ID NO: 1247 - RNA, 23 nt, Homo sapiens
ugucgugcuuccgugaggagagg

SEQ ID NO: 1248 - RNA, 23 nt, Homo sapiens
gucgugcuuccgugaggagaggg

SEQ ID NO: 1249 - RNA, 23 nt, Homo sapiens
ucgugcuuccgugaggagaggga

SEQ ID NO: 1250 - RNA, 23 nt, Homo sapiens
cgugcuuccgugaggagagggac

SEQ ID NO: 1251 - RNA, 23 nt, Homo sapiens
gugcuuccgugaggagagggacg

SEQ ID NO: 1252 - RNA, 23 nt, Homo sapiens
ugcuuccgugaggagagggacgu

SEQ ID NO: 1253 - RNA, 23 nt, Homo sapiens
gcuuccgugaggagagggacgug

SEQ ID NO: 1254 - RNA, 23 nt, Homo sapiens
cuuccgugaggagagggacgugu

SEQ ID NO: 1255 - RNA, 23 nt, Homo sapiens
uuccgugaggagagggacguguu

SEQ ID NO: 1256 - RNA, 23 nt, Homo sapiens
uccgugaggagagggacguguug

SEQ ID NO: 1257 - RNA, 23 nt, Homo sapiens
ccgugaggagagggacguguugg

SEQ ID NO: 1258 - RNA, 23 nt, Homo sapiens
cgugaggagagggacguguuggu

SEQ ID NO: 1259 - RNA, 23 nt, Homo sapiens
gugaggagagggacguguuggug

SEQ ID NO: 1260 - RNA, 23 nt, Homo sapiens
ugaggagagggacguguugguga

SEQ ID NO: 1261 - RNA, 23 nt, Homo sapiens
gaggagagggacguguuggugaa

SEQ ID NO: 1262 - RNA, 23 nt, Homo sapiens
aggagagggacguguuggugaau

SEQ ID NO: 1263 - RNA, 23 nt, Homo sapiens
ggagagggacguguuggugaaug

SEQ ID NO: 1264 - RNA, 23 nt, Homo sapiens
gagagggacguguuggugaaugg

SEQ ID NO: 1265 - RNA, 23 nt, Homo sapiens
agagggacguguuggugaauggg

SEQ ID NO: 1266 - RNA, 23 nt, Homo sapiens
gagggacguguuggugaaugggg

SEQ ID NO: 1267 - RNA, 23 nt, Homo sapiens
agggacguguuggugaaugggga

SEQ ID NO: 1268 - RNA, 23 nt, Homo sapiens
gggacguguuggugaauggggac

SEQ ID NO: 1269 - RNA, 23 nt, Homo sapiens
ggacguguuggugaauggggacc

SEQ ID NO: 1270 - RNA, 23 nt, Homo sapiens
gacguguuggugaauggggaccg

SEQ ID NO: 1271 - RNA, 23 nt, Homo sapiens
acguguuggugaauggggaccgg

SEQ ID NO: 1272 - RNA, 23 nt, Homo sapiens
cguguuggugaauggggaccggc

SEQ ID NO: 1273 - RNA, 23 nt, Homo sapiens
guguuggugaauggggaccggcg

SEQ ID NO: 1274 - RNA, 23 nt, Homo sapiens
uguuggugaauggggaccggcgg

SEQ ID NO: 1275 - RNA, 23 nt, Homo sapiens
guuggugaauggggaccggcggu

SEQ ID NO: 1276 - RNA, 23 nt, Homo sapiens
uuggugaauggggaccggcggug

SEQ ID NO: 1277 - RNA, 23 nt, Homo sapiens
uggugaauggggaccggcggugg

SEQ ID NO: 1278 - RNA, 23 nt, Homo sapiens
ggugaauggggaccggcggugga

SEQ ID NO: 1279 - RNA, 23 nt, Homo sapiens
gugaauggggaccggcgguggau

SEQ ID NO: 1280 - RNA, 23 nt, Homo sapiens
ugaauggggaccggcgguggauc

SEQ ID NO: 1281 - RNA, 23 nt, Homo sapiens
gaauggggaccggcgguggauca

SEQ ID NO: 1282 - RNA, 23 nt, Homo sapiens
aauggggaccggcgguggaucac

SEQ ID NO: 1283 - RNA, 23 nt, Homo sapiens
auggggaccggcgguggaucacg

SEQ ID NO: 1284 - RNA, 23 nt, Homo sapiens
uggggaccggcgguggaucacgc

SEQ ID NO: 1285 - RNA, 23 nt, Homo sapiens
ggggaccggcgguggaucacgca

SEQ ID NO: 1286 - RNA, 23 nt, Homo sapiens
gggaccggcgguggaucacgcag

SEQ ID NO: 1287 - RNA, 23 nt, Homo sapiens
ggaccggcgguggaucacgcagc

SEQ ID NO: 1288 - RNA, 23 nt, Homo sapiens
gaccggcgguggaucacgcagcu

SEQ ID NO: 1289 - RNA, 23 nt, Homo sapiens
accggcgguggaucacgcagcug

SEQ ID NO: 1290 - RNA, 23 nt, Homo sapiens
ccggcgguggaucacgcagcugc

SEQ ID NO: 1291 - RNA, 23 nt, Homo sapiens
cggcgguggaucacgcagcugca

SEQ ID NO: 1292 - RNA, 23 nt, Homo sapiens
ggcgguggaucacgcagcugcac

SEQ ID NO: 1293 - RNA, 23 nt, Homo sapiens
gcgguggaucacgcagcugcacu

SEQ ID NO: 1294 - RNA, 23 nt, Homo sapiens
cgguggaucacgcagcugcacuu

SEQ ID NO: 1295 - RNA, 23 nt, Homo sapiens
gguggaucacgcagcugcacuuc

SEQ ID NO: 1296 - RNA, 23 nt, Homo sapiens
guggaucacgcagcugcacuucg

SEQ ID NO: 1297 - RNA, 23 nt, Homo sapiens
uggaucacgcagcugcacuucgc

SEQ ID NO: 1298 - RNA, 23 nt, Homo sapiens
ggaucacgcagcugcacuucgcc

SEQ ID NO: 1299 - RNA, 23 nt, Homo sapiens
gaucacgcagcugcacuucgccu

SEQ ID NO: 1300 - RNA, 23 nt, Homo sapiens
aucacgcagcugcacuucgccuu

SEQ ID NO: 1301 - RNA, 23 nt, Homo sapiens
ucacgcagcugcacuucgccuuc

SEQ ID NO: 1302 - RNA, 23 nt, Homo sapiens
cacgcagcugcacuucgccuucc

SEQ ID NO: 1303 - RNA, 23 nt, Homo sapiens
acgcagcugcacuucgccuucca

SEQ ID NO: 1304 - RNA, 23 nt, Homo sapiens
cgcagcugcacuucgccuuccag

SEQ ID NO: 1305 - RNA, 23 nt, Homo sapiens
gcagcugcacuucgccuuccagg

SEQ ID NO: 1306 - RNA, 23 nt, Homo sapiens
cagcugcacuucgccuuccagga

SEQ ID NO: 1307 - RNA, 23 nt, Homo sapiens
agcugcacuucgccuuccaggau

SEQ ID NO: 1308 - RNA, 23 nt, Homo sapiens
gcugcacuucgccuuccaggaug

SEQ ID NO: 1309 - RNA, 23 nt, Homo sapiens
cugcacuucgccuuccaggauga

SEQ ID NO: 1310 - RNA, 23 nt, Homo sapiens
ugcacuucgccuuccaggaugag

SEQ ID NO: 1311 - RNA, 23 nt, Homo sapiens
gcacuucgccuuccaggaugaga

SEQ ID NO: 1312 - RNA, 23 nt, Homo sapiens
cacuucgccuuccaggaugagaa

SEQ ID NO: 1313 - RNA, 23 nt, Homo sapiens
acuucgccuuccaggaugagaac

SEQ ID NO: 1314 - RNA, 23 nt, Homo sapiens
cuucgccuuccaggaugagaacu

SEQ ID NO: 1315 - RNA, 23 nt, Homo sapiens
uucgccuuccaggaugagaacua

SEQ ID NO: 1316 - RNA, 23 nt, Homo sapiens
ucgccuuccaggaugagaacuac

SEQ ID NO: 1317 - RNA, 23 nt, Homo sapiens
cgccuuccaggaugagaacuacc

SEQ ID NO: 1318 - RNA, 23 nt, Homo sapiens
gccuuccaggaugagaacuaccu

SEQ ID NO: 1319 - RNA, 23 nt, Homo sapiens
ccuuccaggaugagaacuaccug

SEQ ID NO: 1320 - RNA, 23 nt, Homo sapiens
cuuccaggaugagaacuaccugu

SEQ ID NO: 1321 - RNA, 23 nt, Homo sapiens
uuccaggaugagaacuaccugua

SEQ ID NO: 1322 - RNA, 23 nt, Homo sapiens
uccaggaugagaacuaccuguac

SEQ ID NO: 1323 - RNA, 23 nt, Homo sapiens
ccaggaugagaacuaccuguacc

SEQ ID NO: 1324 - RNA, 23 nt, Homo sapiens
caggaugagaacuaccuguaccu

SEQ ID NO: 1325 - RNA, 23 nt, Homo sapiens
aggaugagaacuaccuguaccug

SEQ ID NO: 1326 - RNA, 23 nt, Homo sapiens
ggaugagaacuaccuguaccugg

SEQ ID NO: 1327 - RNA, 23 nt, Homo sapiens
gaugagaacuaccuguaccuggu

SEQ ID NO: 1328 - RNA, 23 nt, Homo sapiens
augagaacuaccuguaccugguc

SEQ ID NO: 1329 - RNA, 23 nt, Homo sapiens
ugagaacuaccuguaccugguca

SEQ ID NO: 1330 - RNA, 23 nt, Homo sapiens
gagaacuaccuguaccuggucau

SEQ ID NO: 1331 - RNA, 23 nt, Homo sapiens
agaacuaccuguaccuggucaug

SEQ ID NO: 1332 - RNA, 23 nt, Homo sapiens
gaacuaccuguaccuggucaugg

SEQ ID NO: 1333 - RNA, 23 nt, Homo sapiens
aacuaccuguaccuggucaugga

SEQ ID NO: 1334 - RNA, 23 nt, Homo sapiens
acuaccuguaccuggucauggag

SEQ ID NO: 1335 - RNA, 23 nt, Homo sapiens
cuaccuguaccuggucauggagu

SEQ ID NO: 1336 - RNA, 23 nt, Homo sapiens
uaccuguaccuggucauggagua

SEQ ID NO: 1337 - RNA, 23 nt, Homo sapiens
accuguaccuggucauggaguau

SEQ ID NO: 1338 - RNA, 23 nt, Homo sapiens
ccuguaccuggucauggaguauu

SEQ ID NO: 1339 - RNA, 23 nt, Homo sapiens
cuguaccuggucauggaguauua

SEQ ID NO: 1340 - RNA, 23 nt, Homo sapiens
uguaccuggucauggaguauuac

SEQ ID NO: 1341 - RNA, 23 nt, Homo sapiens
guaccuggucauggaguauuacg

SEQ ID NO: 1342 - RNA, 23 nt, Homo sapiens
uaccuggucauggaguauuacgu

SEQ ID NO: 1343 - RNA, 23 nt, Homo sapiens
accuggucauggaguauuacgug

SEQ ID NO: 1344 - RNA, 23 nt, Homo sapiens
ccuggucauggaguauuacgugg

SEQ ID NO: 1345 - RNA, 23 nt, Homo sapiens
cuggucauggaguauuacguggg

SEQ ID NO: 1346 - RNA, 23 nt, Homo sapiens
uggucauggaguauuacgugggc

SEQ ID NO: 1347 - RNA, 23 nt, Homo sapiens
ggucauggaguauuacgugggcg

SEQ ID NO: 1348 - RNA, 23 nt, Homo sapiens
gucauggaguauuacgugggcgg

SEQ ID NO: 1349 - RNA, 23 nt, Homo sapiens
ucauggaguauuacgugggcggg

SEQ ID NO: 1350 - RNA, 23 nt, Homo sapiens
cauggaguauuacgugggcgggg

SEQ ID NO: 1351 - RNA, 23 nt, Homo sapiens
auggaguauuacgugggcgggga

SEQ ID NO: 1352 - RNA, 23 nt, Homo sapiens
uggaguauuacgugggcggggac

SEQ ID NO: 1353 - RNA, 23 nt, Homo sapiens
ggaguauuacgugggcggggacc

SEQ ID NO: 1354 - RNA, 23 nt, Homo sapiens
gaguauuacgugggcggggaccu

SEQ ID NO: 1355 - RNA, 23 nt, Homo sapiens
aguauuacgugggcggggaccug

SEQ ID NO: 1356 - RNA, 23 nt, Homo sapiens
guauuacgugggcggggaccugc

SEQ ID NO: 1357 - RNA, 23 nt, Homo sapiens
uauuacgugggcggggaccugcu

SEQ ID NO: 1358 - RNA, 23 nt, Homo sapiens
auuacgugggcggggaccugcug

SEQ ID NO: 1359 - RNA, 23 nt, Homo sapiens
uuacgugggcggggaccugcuga

SEQ ID NO: 1360 - RNA, 23 nt, Homo sapiens
uacgugggcggggaccugcugac

SEQ ID NO: 1361 - RNA, 23 nt, Homo sapiens
acgugggcggggaccugcugaca

SEQ ID NO: 1362 - RNA, 23 nt, Homo sapiens
cgugggcggggaccugcugacac

SEQ ID NO: 1363 - RNA, 23 nt, Homo sapiens
gugggcggggaccugcugacacu

SEQ ID NO: 1364 - RNA, 23 nt, Homo sapiens
ugggcggggaccugcugacacug

SEQ ID NO: 1365 - RNA, 23 nt, Homo sapiens
gggcggggaccugcugacacugc

SEQ ID NO: 1366 - RNA, 23 nt, Homo sapiens
ggcggggaccugcugacacugcu

SEQ ID NO: 1367 - RNA, 23 nt, Homo sapiens
gcggggaccugcugacacugcug

SEQ ID NO: 1368 - RNA, 23 nt, Homo sapiens
cggggaccugcugacacugcuga

SEQ ID NO: 1369 - RNA, 23 nt, Homo sapiens
ggggaccugcugacacugcugag

SEQ ID NO: 1370 - RNA, 23 nt, Homo sapiens
gggaccugcugacacugcugagc

SEQ ID NO: 1371 - RNA, 23 nt, Homo sapiens
ggaccugcugacacugcugagca

SEQ ID NO: 1372 - RNA, 23 nt, Homo sapiens
gaccugcugacacugcugagcaa

SEQ ID NO: 1373 - RNA, 23 nt, Homo sapiens
accugcugacacugcugagcaag

SEQ ID NO: 1374 - RNA, 23 nt, Homo sapiens
ccugcugacacugcugagcaagu

SEQ ID NO: 1375 - RNA, 23 nt, Homo sapiens
cugcugacacugcugagcaaguu

SEQ ID NO: 1376 - RNA, 23 nt, Homo sapiens
ugcugacacugcugagcaaguuu

SEQ ID NO: 1377 - RNA, 23 nt, Homo sapiens
gcugacacugcugagcaaguuug

SEQ ID NO: 1378 - RNA, 23 nt, Homo sapiens
cugacacugcugagcaaguuugg

SEQ ID NO: 1379 - RNA, 23 nt, Homo sapiens
ugacacugcugagcaaguuuggg

SEQ ID NO: 1380 - RNA, 23 nt, Homo sapiens
gacacugcugagcaaguuugggg

SEQ ID NO: 1381 - RNA, 23 nt, Homo sapiens
acacugcugagcaaguuugggga

SEQ ID NO: 1382 - RNA, 23 nt, Homo sapiens
cacugcugagcaaguuuggggag

SEQ ID NO: 1383 - RNA, 23 nt, Homo sapiens
acugcugagcaaguuuggggagc

SEQ ID NO: 1384 - RNA, 23 nt, Homo sapiens
cugcugagcaaguuuggggagcg

SEQ ID NO: 1385 - RNA, 23 nt, Homo sapiens
ugcugagcaaguuuggggagcgg

SEQ ID NO: 1386 - RNA, 23 nt, Homo sapiens
gcugagcaaguuuggggagcgga

SEQ ID NO: 1387 - RNA, 23 nt, Homo sapiens
cugagcaaguuuggggagcggau

SEQ ID NO: 1388 - RNA, 23 nt, Homo sapiens
ugagcaaguuuggggagcggauu

SEQ ID NO: 1389 - RNA, 23 nt, Homo sapiens
gagcaaguuuggggagcggauuc

SEQ ID NO: 1390 - RNA, 23 nt, Homo sapiens
agcaaguuuggggagcggauucc

SEQ ID NO: 1391 - RNA, 23 nt, Homo sapiens
gcaaguuuggggagcggauuccg

SEQ ID NO: 1392 - RNA, 23 nt, Homo sapiens
caaguuuggggagcggauuccgg

SEQ ID NO: 1393 - RNA, 23 nt, Homo sapiens
aaguuuggggagcggauuccggc

SEQ ID NO: 1394 - RNA, 23 nt, Homo sapiens
aguuuggggagcggauuccggcc

SEQ ID NO: 1395 - RNA, 23 nt, Homo sapiens
guuuggggagcggauuccggccg

SEQ ID NO: 1396 - RNA, 23 nt, Homo sapiens
uuuggggagcggauuccggccga

SEQ ID NO: 1397 - RNA, 23 nt, Homo sapiens
uuggggagcggauuccggccgag

SEQ ID NO: 1398 - RNA, 23 nt, Homo sapiens
uggggagcggauuccggccgaga

SEQ ID NO: 1399 - RNA, 23 nt, Homo sapiens
ggggagcggauuccggccgagau

SEQ ID NO: 1400 - RNA, 23 nt, Homo sapiens
gggagcggauuccggccgagaug

SEQ ID NO: 1401 - RNA, 23 nt, Homo sapiens
ggagcggauuccggccgagaugg

SEQ ID NO: 1402 - RNA, 23 nt, Homo sapiens
gagcggauuccggccgagauggc

SEQ ID NO: 1403 - RNA, 23 nt, Homo sapiens
agcggauuccggccgagauggcg

SEQ ID NO: 1404 - RNA, 23 nt, Homo sapiens
gcggauuccggccgagauggcgc

SEQ ID NO: 1405 - RNA, 23 nt, Homo sapiens
cggauuccggccgagauggcgcg

SEQ ID NO: 1406 - RNA, 23 nt, Homo sapiens
ggauuccggccgagauggcgcgc

SEQ ID NO: 1407 - RNA, 23 nt, Homo sapiens
gauuccggccgagauggcgcgcu

SEQ ID NO: 1408 - RNA, 23 nt, Homo sapiens
auuccggccgagauggcgcgcuu

SEQ ID NO: 1409 - RNA, 23 nt, Homo sapiens
uuccggccgagauggcgcgcuuc

SEQ ID NO: 1410 - RNA, 23 nt, Homo sapiens
uccggccgagauggcgcgcuucu

SEQ ID NO: 1411 - RNA, 23 nt, Homo sapiens
ccggccgagauggcgcgcuucua

SEQ ID NO: 1412 - RNA, 23 nt, Homo sapiens
cggccgagauggcgcgcuucuac

SEQ ID NO: 1413 - RNA, 23 nt, Homo sapiens
ggccgagauggcgcgcuucuacc

SEQ ID NO: 1414 - RNA, 23 nt, Homo sapiens
gccgagauggcgcgcuucuaccu

SEQ ID NO: 1415 - RNA, 23 nt, Homo sapiens
ccgagauggcgcgcuucuaccug

SEQ ID NO: 1416 - RNA, 23 nt, Homo sapiens
cgagauggcgcgcuucuaccugg

SEQ ID NO: 1417 - RNA, 23 nt, Homo sapiens
gagauggcgcgcuucuaccuggc

SEQ ID NO: 1418 - RNA, 23 nt, Homo sapiens
agauggcgcgcuucuaccuggcg

SEQ ID NO: 1419 - RNA, 23 nt, Homo sapiens
gauggcgcgcuucuaccuggcgg

SEQ ID NO: 1420 - RNA, 23 nt, Homo sapiens
auggcgcgcuucuaccuggcgga

SEQ ID NO: 1421 - RNA, 23 nt, Homo sapiens
uggcgcgcuucuaccuggcggag

SEQ ID NO: 1422 - RNA, 23 nt, Homo sapiens
ggcgcgcuucuaccuggcggaga

SEQ ID NO: 1423 - RNA, 23 nt, Homo sapiens
gcgcgcuucuaccuggcggagau

SEQ ID NO: 1424 - RNA, 23 nt, Homo sapiens
cgcgcuucuaccuggcggagauu

SEQ ID NO: 1425 - RNA, 23 nt, Homo sapiens
gcgcuucuaccuggcggagauug

SEQ ID NO: 1426 - RNA, 23 nt, Homo sapiens
cgcuucuaccuggcggagauugu

SEQ ID NO: 1427 - RNA, 23 nt, Homo sapiens
gcuucuaccuggcggagauuguc

SEQ ID NO: 1428 - RNA, 23 nt, Homo sapiens
cuucuaccuggcggagauuguca

SEQ ID NO: 1429 - RNA, 23 nt, Homo sapiens
uucuaccuggcggagauugucau

SEQ ID NO: 1430 - RNA, 23 nt, Homo sapiens
ucuaccuggcggagauugucaug

SEQ ID NO: 1431 - RNA, 23 nt, Homo sapiens
cuaccuggcggagauugucaugg

SEQ ID NO: 1432 - RNA, 23 nt, Homo sapiens
uaccuggcggagauugucauggc

SEQ ID NO: 1433 - RNA, 23 nt, Homo sapiens
accuggcggagauugucauggcc

SEQ ID NO: 1434 - RNA, 23 nt, Homo sapiens
ccuggcggagauugucauggcca

SEQ ID NO: 1435 - RNA, 23 nt, Homo sapiens
cuggcggagauugucauggccau

SEQ ID NO: 1436 - RNA, 23 nt, Homo sapiens
uggcggagauugucauggccaua

SEQ ID NO: 1437 - RNA, 23 nt, Homo sapiens
ggcggagauugucauggccauag

SEQ ID NO: 1438 - RNA, 23 nt, Homo sapiens
gcggagauugucauggccauaga

SEQ ID NO: 1439 - RNA, 23 nt, Homo sapiens
cggagauugucauggccauagac

SEQ ID NO: 1440 - RNA, 23 nt, Homo sapiens
ggagauugucauggccauagacu

SEQ ID NO: 1441 - RNA, 23 nt, Homo sapiens
gagauugucauggccauagacuc

SEQ ID NO: 1442 - RNA, 23 nt, Homo sapiens
agauugucauggccauagacucg

SEQ ID NO: 1443 - RNA, 23 nt, Homo sapiens
gauugucauggccauagacucgg

SEQ ID NO: 1444 - RNA, 23 nt, Homo sapiens
auugucauggccauagacucggu

SEQ ID NO: 1445 - RNA, 23 nt, Homo sapiens
uugucauggccauagacucggug

SEQ ID NO: 1446 - RNA, 23 nt, Homo sapiens
ugucauggccauagacucggugc

SEQ ID NO: 1447 - RNA, 23 nt, Homo sapiens
gucauggccauagacucggugca

SEQ ID NO: 1448 - RNA, 23 nt, Homo sapiens
ucauggccauagacucggugcac

SEQ ID NO: 1449 - RNA, 23 nt, Homo sapiens
cauggccauagacucggugcacc

SEQ ID NO: 1450 - RNA, 23 nt, Homo sapiens
auggccauagacucggugcaccg

SEQ ID NO: 1451 - RNA, 23 nt, Homo sapiens
uggccauagacucggugcaccgg

SEQ ID NO: 1452 - RNA, 23 nt, Homo sapiens
ggccauagacucggugcaccggc

SEQ ID NO: 1453 - RNA, 23 nt, Homo sapiens
gccauagacucggugcaccggcu

SEQ ID NO: 1454 - RNA, 23 nt, Homo sapiens
ccauagacucggugcaccggcuu

SEQ ID NO: 1455 - RNA, 23 nt, Homo sapiens
cauagacucggugcaccggcuug

SEQ ID NO: 1456 - RNA, 23 nt, Homo sapiens
auagacucggugcaccggcuugg

SEQ ID NO: 1457 - RNA, 23 nt, Homo sapiens
uagacucggugcaccggcuuggc

SEQ ID NO: 1458 - RNA, 23 nt, Homo sapiens
agacucggugcaccggcuuggcu

SEQ ID NO: 1459 - RNA, 23 nt, Homo sapiens
gacucggugcaccggcuuggcua

SEQ ID NO: 1460 - RNA, 23 nt, Homo sapiens
acucggugcaccggcuuggcuac

SEQ ID NO: 1461 - RNA, 23 nt, Homo sapiens
cucggugcaccggcuuggcuacg

SEQ ID NO: 1462 - RNA, 23 nt, Homo sapiens
ucggugcaccggcuuggcuacgu

SEQ ID NO: 1463 - RNA, 23 nt, Homo sapiens
cggugcaccggcuuggcuacgug

SEQ ID NO: 1464 - RNA, 23 nt, Homo sapiens
ggugcaccggcuuggcuacgugc

SEQ ID NO: 1465 - RNA, 23 nt, Homo sapiens
gugcaccggcuuggcuacgugca

SEQ ID NO: 1466 - RNA, 23 nt, Homo sapiens
ugcaccggcuuggcuacgugcac

SEQ ID NO: 1467 - RNA, 23 nt, Homo sapiens
gcaccggcuuggcuacgugcaca

SEQ ID NO: 1468 - RNA, 23 nt, Homo sapiens
caccggcuuggcuacgugcacag

SEQ ID NO: 1469 - RNA, 23 nt, Homo sapiens
accggcuuggcuacgugcacagg

SEQ ID NO: 1470 - RNA, 23 nt, Homo sapiens
ccggcuuggcuacgugcacaggg

SEQ ID NO: 1471 - RNA, 23 nt, Homo sapiens
cggcuuggcuacgugcacaggga

SEQ ID NO: 1472 - RNA, 23 nt, Homo sapiens
ggcuuggcuacgugcacagggac

SEQ ID NO: 1473 - RNA, 23 nt, Homo sapiens
gcuuggcuacgugcacagggaca

SEQ ID NO: 1474 - RNA, 23 nt, Homo sapiens
cuuggcuacgugcacagggacau

SEQ ID NO: 1475 - RNA, 23 nt, Homo sapiens
uuggcuacgugcacagggacauc

SEQ ID NO: 1476 - RNA, 23 nt, Homo sapiens
uggcuacgugcacagggacauca

SEQ ID NO: 1477 - RNA, 23 nt, Homo sapiens
ggcuacgugcacagggacaucaa

SEQ ID NO: 1478 - RNA, 23 nt, Homo sapiens
gcuacgugcacagggacaucaaa

SEQ ID NO: 1479 - RNA, 23 nt, Homo sapiens
cuacgugcacagggacaucaaac

SEQ ID NO: 1480 - RNA, 23 nt, Homo sapiens
uacgugcacagggacaucaaacc

SEQ ID NO: 1481 - RNA, 23 nt, Homo sapiens
acgugcacagggacaucaaaccc

SEQ ID NO: 1482 - RNA, 23 nt, Homo sapiens
cgugcacagggacaucaaacccg

SEQ ID NO: 1483 - RNA, 23 nt, Homo sapiens
gugcacagggacaucaaacccga

SEQ ID NO: 1484 - RNA, 23 nt, Homo sapiens
ugcacagggacaucaaacccgac

SEQ ID NO: 1485 - RNA, 23 nt, Homo sapiens
gcacagggacaucaaacccgaca

SEQ ID NO: 1486 - RNA, 23 nt, Homo sapiens
cacagggacaucaaacccgacaa

SEQ ID NO: 1487 - RNA, 23 nt, Homo sapiens
acagggacaucaaacccgacaac

SEQ ID NO: 1488 - RNA, 23 nt, Homo sapiens
cagggacaucaaacccgacaaca

SEQ ID NO: 1489 - RNA, 23 nt, Homo sapiens
agggacaucaaacccgacaacau

SEQ ID NO: 1490 - RNA, 23 nt, Homo sapiens
gggacaucaaacccgacaacauc

SEQ ID NO: 1491 - RNA, 23 nt, Homo sapiens
ggacaucaaacccgacaacaucc

SEQ ID NO: 1492 - RNA, 23 nt, Homo sapiens
gacaucaaacccgacaacauccu

SEQ ID NO: 1493 - RNA, 23 nt, Homo sapiens
acaucaaacccgacaacauccug

SEQ ID NO: 1494 - RNA, 23 nt, Homo sapiens
caucaaacccgacaacauccugc

SEQ ID NO: 1495 - RNA, 23 nt, Homo sapiens
aucaaacccgacaacauccugcu

SEQ ID NO: 1496 - RNA, 23 nt, Homo sapiens
ucaaacccgacaacauccugcug

SEQ ID NO: 1497 - RNA, 23 nt, Homo sapiens
caaacccgacaacauccugcugg

SEQ ID NO: 1498 - RNA, 23 nt, Homo sapiens
aaacccgacaacauccugcugga

SEQ ID NO: 1499 - RNA, 23 nt, Homo sapiens
aacccgacaacauccugcuggac

SEQ ID NO: 1500 - RNA, 23 nt, Homo sapiens
acccgacaacauccugcuggacc

SEQ ID NO: 1501 - RNA, 23 nt, Homo sapiens
cccgacaacauccugcuggaccg

SEQ ID NO: 1502 - RNA, 23 nt, Homo sapiens
ccgacaacauccugcuggaccgc

SEQ ID NO: 1503 - RNA, 23 nt, Homo sapiens
cgacaacauccugcuggaccgcu

SEQ ID NO: 1504 - RNA, 23 nt, Homo sapiens
gacaacauccugcuggaccgcug

SEQ ID NO: 1505 - RNA, 23 nt, Homo sapiens
acaacauccugcuggaccgcugu

SEQ ID NO: 1506 - RNA, 23 nt, Homo sapiens
caacauccugcuggaccgcugug

SEQ ID NO: 1507 - RNA, 23 nt, Homo sapiens
aacauccugcuggaccgcugugg

SEQ ID NO: 1508 - RNA, 23 nt, Homo sapiens
acauccugcuggaccgcuguggc

SEQ ID NO: 1509 - RNA, 23 nt, Homo sapiens
cauccugcuggaccgcuguggcc

SEQ ID NO: 1510 - RNA, 23 nt, Homo sapiens
auccugcuggaccgcuguggcca

SEQ ID NO: 1511 - RNA, 23 nt, Homo sapiens
uccugcuggaccgcuguggccac

SEQ ID NO: 1512 - RNA, 23 nt, Homo sapiens
ccugcuggaccgcuguggccaca

SEQ ID NO: 1513 - RNA, 23 nt, Homo sapiens
cugcuggaccgcuguggccacau

SEQ ID NO: 1514 - RNA, 23 nt, Homo sapiens
ugcuggaccgcuguggccacauc

SEQ ID NO: 1515 - RNA, 23 nt, Homo sapiens
gcuggaccgcuguggccacaucc

SEQ ID NO: 1516 - RNA, 23 nt, Homo sapiens
cuggaccgcuguggccacauccg

SEQ ID NO: 1517 - RNA, 23 nt, Homo sapiens
uggaccgcuguggccacauccgc

SEQ ID NO: 1518 - RNA, 23 nt, Homo sapiens
ggaccgcuguggccacauccgcc

SEQ ID NO: 1519 - RNA, 23 nt, Homo sapiens
gaccgcuguggccacauccgccu

SEQ ID NO: 1520 - RNA, 23 nt, Homo sapiens
accgcuguggccacauccgccug

SEQ ID NO: 1521 - RNA, 23 nt, Homo sapiens
ccgcuguggccacauccgccugg

SEQ ID NO: 1522 - RNA, 23 nt, Homo sapiens
cgcuguggccacauccgccuggc

SEQ ID NO: 1523 - RNA, 23 nt, Homo sapiens
gcuguggccacauccgccuggcc

SEQ ID NO: 1524 - RNA, 23 nt, Homo sapiens
cuguggccacauccgccuggccg

SEQ ID NO: 1525 - RNA, 23 nt, Homo sapiens
uguggccacauccgccuggccga

SEQ ID NO: 1526 - RNA, 23 nt, Homo sapiens
guggccacauccgccuggccgac

SEQ ID NO: 1527 - RNA, 23 nt, Homo sapiens
uggccacauccgccuggccgacu

SEQ ID NO: 1528 - RNA, 23 nt, Homo sapiens
ggccacauccgccuggccgacuu

SEQ ID NO: 1529 - RNA, 23 nt, Homo sapiens
gccacauccgccuggccgacuuc

SEQ ID NO: 1530 - RNA, 23 nt, Homo sapiens
ccacauccgccuggccgacuucg

SEQ ID NO: 1531 - RNA, 23 nt, Homo sapiens
cacauccgccuggccgacuucgg

SEQ ID NO: 1532 - RNA, 23 nt, Homo sapiens
acauccgccuggccgacuucggc

SEQ ID NO: 1533 - RNA, 23 nt, Homo sapiens
cauccgccuggccgacuucggcu

SEQ ID NO: 1534 - RNA, 23 nt, Homo sapiens
auccgccuggccgacuucggcuc

SEQ ID NO: 1535 - RNA, 23 nt, Homo sapiens
uccgccuggccgacuucggcucu

SEQ ID NO: 1536 - RNA, 23 nt, Homo sapiens
ccgccuggccgacuucggcucuu

SEQ ID NO: 1537 - RNA, 23 nt, Homo sapiens
cgccuggccgacuucggcucuug

SEQ ID NO: 1538 - RNA, 23 nt, Homo sapiens
gccuggccgacuucggcucuugc

SEQ ID NO: 1539 - RNA, 23 nt, Homo sapiens
ccuggccgacuucggcucuugcc

SEQ ID NO: 1540 - RNA, 23 nt, Homo sapiens
cuggccgacuucggcucuugccu

SEQ ID NO: 1541 - RNA, 23 nt, Homo sapiens
uggccgacuucggcucuugccuc

SEQ ID NO: 1542 - RNA, 23 nt, Homo sapiens
ggccgacuucggcucuugccuca

SEQ ID NO: 1543 - RNA, 23 nt, Homo sapiens
gccgacuucggcucuugccucaa

SEQ ID NO: 1544 - RNA, 23 nt, Homo sapiens
ccgacuucggcucuugccucaag

SEQ ID NO: 1545 - RNA, 23 nt, Homo sapiens
cgacuucggcucuugccucaagc

SEQ ID NO: 1546 - RNA, 23 nt, Homo sapiens
gacuucggcucuugccucaagcu

SEQ ID NO: 1547 - RNA, 23 nt, Homo sapiens
acuucggcucuugccucaagcug

SEQ ID NO: 1548 - RNA, 23 nt, Homo sapiens
cuucggcucuugccucaagcugc

SEQ ID NO: 1549 - RNA, 23 nt, Homo sapiens
uucggcucuugccucaagcugcg

SEQ ID NO: 1550 - RNA, 23 nt, Homo sapiens
ucggcucuugccucaagcugcgg

SEQ ID NO: 1551 - RNA, 23 nt, Homo sapiens
cggcucuugccucaagcugcggg

SEQ ID NO: 1552 - RNA, 23 nt, Homo sapiens
ggcucuugccucaagcugcgggc

SEQ ID NO: 1553 - RNA, 23 nt, Homo sapiens
gcucuugccucaagcugcgggca

SEQ ID NO: 1554 - RNA, 23 nt, Homo sapiens
cucuugccucaagcugcgggcag

SEQ ID NO: 1555 - RNA, 23 nt, Homo sapiens
ucuugccucaagcugcgggcaga

SEQ ID NO: 1556 - RNA, 23 nt, Homo sapiens
cuugccucaagcugcgggcagau

SEQ ID NO: 1557 - RNA, 23 nt, Homo sapiens
uugccucaagcugcgggcagaug

SEQ ID NO: 1558 - RNA, 23 nt, Homo sapiens
ugccucaagcugcgggcagaugg

SEQ ID NO: 1559 - RNA, 23 nt, Homo sapiens
gccucaagcugcgggcagaugga

SEQ ID NO: 1560 - RNA, 23 nt, Homo sapiens
ccucaagcugcgggcagauggaa

SEQ ID NO: 1561 - RNA, 23 nt, Homo sapiens
cucaagcugcgggcagauggaac

SEQ ID NO: 1562 - RNA, 23 nt, Homo sapiens
ucaagcugcgggcagauggaacg

SEQ ID NO: 1563 - RNA, 23 nt, Homo sapiens
caagcugcgggcagauggaacgg

SEQ ID NO: 1564 - RNA, 23 nt, Homo sapiens
aagcugcgggcagauggaacggu

SEQ ID NO: 1565 - RNA, 23 nt, Homo sapiens
agcugcgggcagauggaacggug

SEQ ID NO: 1566 - RNA, 23 nt, Homo sapiens
gcugcgggcagauggaacggugc

SEQ ID NO: 1567 - RNA, 23 nt, Homo sapiens
cugcgggcagauggaacggugcg

SEQ ID NO: 1568 - RNA, 23 nt, Homo sapiens
ugcgggcagauggaacggugcgg

SEQ ID NO: 1569 - RNA, 23 nt, Homo sapiens
gcgggcagauggaacggugcggu

SEQ ID NO: 1570 - RNA, 23 nt, Homo sapiens
cgggcagauggaacggugcgguc

SEQ ID NO: 1571 - RNA, 23 nt, Homo sapiens
gggcagauggaacggugcggucg

SEQ ID NO: 1572 - RNA, 23 nt, Homo sapiens
ggcagauggaacggugcggucgc

SEQ ID NO: 1573 - RNA, 23 nt, Homo sapiens
gcagauggaacggugcggucgcu

SEQ ID NO: 1574 - RNA, 23 nt, Homo sapiens
cagauggaacggugcggucgcug

SEQ ID NO: 1575 - RNA, 23 nt, Homo sapiens
agauggaacggugcggucgcugg

SEQ ID NO: 1576 - RNA, 23 nt, Homo sapiens
gauggaacggugcggucgcuggu

SEQ ID NO: 1577 - RNA, 23 nt, Homo sapiens
auggaacggugcggucgcuggug

SEQ ID NO: 1578 - RNA, 23 nt, Homo sapiens
uggaacggugcggucgcuggugg

SEQ ID NO: 1579 - RNA, 23 nt, Homo sapiens
ggaacggugcggucgcugguggc

SEQ ID NO: 1580 - RNA, 23 nt, Homo sapiens
gaacggugcggucgcugguggcu

SEQ ID NO: 1581 - RNA, 23 nt, Homo sapiens
aacggugcggucgcugguggcug

SEQ ID NO: 1582 - RNA, 23 nt, Homo sapiens
acggugcggucgcugguggcugu

SEQ ID NO: 1583 - RNA, 23 nt, Homo sapiens
cggugcggucgcugguggcugug

SEQ ID NO: 1584 - RNA, 23 nt, Homo sapiens
ggugcggucgcugguggcugugg

SEQ ID NO: 1585 - RNA, 23 nt, Homo sapiens
gugcggucgcugguggcuguggg

SEQ ID NO: 1586 - RNA, 23 nt, Homo sapiens
ugcggucgcugguggcugugggc

SEQ ID NO: 1587 - RNA, 23 nt, Homo sapiens
gcggucgcugguggcugugggca

SEQ ID NO: 1588 - RNA, 23 nt, Homo sapiens
cggucgcugguggcugugggcac

SEQ ID NO: 1589 - RNA, 23 nt, Homo sapiens
ggucgcugguggcugugggcacc

SEQ ID NO: 1590 - RNA, 23 nt, Homo sapiens
gucgcugguggcugugggcaccc

SEQ ID NO: 1591 - RNA, 23 nt, Homo sapiens
ucgcugguggcugugggcacccc

SEQ ID NO: 1592 - RNA, 23 nt, Homo sapiens
cgcugguggcugugggcacccca

SEQ ID NO: 1593 - RNA, 23 nt, Homo sapiens
gcugguggcugugggcaccccag

SEQ ID NO: 1594 - RNA, 23 nt, Homo sapiens
cugguggcugugggcaccccaga

SEQ ID NO: 1595 - RNA, 23 nt, Homo sapiens
ugguggcugugggcaccccagac

SEQ ID NO: 1596 - RNA, 23 nt, Homo sapiens
gguggcugugggcaccccagacu

SEQ ID NO: 1597 - RNA, 23 nt, Homo sapiens
guggcugugggcaccccagacua

SEQ ID NO: 1598 - RNA, 23 nt, Homo sapiens
uggcugugggcaccccagacuac

SEQ ID NO: 1599 - RNA, 23 nt, Homo sapiens
ggcugugggcaccccagacuacc

SEQ ID NO: 1600 - RNA, 23 nt, Homo sapiens
gcugugggcaccccagacuaccu

SEQ ID NO: 1601 - RNA, 23 nt, Homo sapiens
cugugggcaccccagacuaccug

SEQ ID NO: 1602 - RNA, 23 nt, Homo sapiens
ugugggcaccccagacuaccugu

SEQ ID NO: 1603 - RNA, 23 nt, Homo sapiens
gugggcaccccagacuaccuguc

SEQ ID NO: 1604 - RNA, 23 nt, Homo sapiens
ugggcaccccagacuaccugucc

SEQ ID NO: 1605 - RNA, 23 nt, Homo sapiens
gggcaccccagacuaccuguccc

SEQ ID NO: 1606 - RNA, 23 nt, Homo sapiens
ggcaccccagacuaccugucccc

SEQ ID NO: 1607 - RNA, 23 nt, Homo sapiens
gcaccccagacuaccuguccccc

SEQ ID NO: 1608 - RNA, 23 nt, Homo sapiens
caccccagacuaccugucccccg

SEQ ID NO: 1609 - RNA, 23 nt, Homo sapiens
accccagacuaccugucccccga

SEQ ID NO: 1610 - RNA, 23 nt, Homo sapiens
ccccagacuaccugucccccgag

SEQ ID NO: 1611 - RNA, 23 nt, Homo sapiens
cccagacuaccugucccccgaga

SEQ ID NO: 1612 - RNA, 23 nt, Homo sapiens
ccagacuaccugucccccgagau

SEQ ID NO: 1613 - RNA, 23 nt, Homo sapiens
cagacuaccugucccccgagauc

SEQ ID NO: 1614 - RNA, 23 nt, Homo sapiens
agacuaccugucccccgagaucc

SEQ ID NO: 1615 - RNA, 23 nt, Homo sapiens
gacuaccugucccccgagauccu

SEQ ID NO: 1616 - RNA, 23 nt, Homo sapiens
acuaccugucccccgagauccug

SEQ ID NO: 1617 - RNA, 23 nt, Homo sapiens
cuaccugucccccgagauccugc

SEQ ID NO: 1618 - RNA, 23 nt, Homo sapiens
uaccugucccccgagauccugca

SEQ ID NO: 1619 - RNA, 23 nt, Homo sapiens
accugucccccgagauccugcag

SEQ ID NO: 1620 - RNA, 23 nt, Homo sapiens
ccugucccccgagauccugcagg

SEQ ID NO: 1621 - RNA, 23 nt, Homo sapiens
cugucccccgagauccugcaggc

SEQ ID NO: 1622 - RNA, 23 nt, Homo sapiens
ugucccccgagauccugcaggcu

SEQ ID NO: 1623 - RNA, 23 nt, Homo sapiens
gucccccgagauccugcaggcug

SEQ ID NO: 1624 - RNA, 23 nt, Homo sapiens
ucccccgagauccugcaggcugu

SEQ ID NO: 1625 - RNA, 23 nt, Homo sapiens
cccccgagauccugcaggcugug

SEQ ID NO: 1626 - RNA, 23 nt, Homo sapiens
ccccgagauccugcaggcugugg

SEQ ID NO: 1627 - RNA, 23 nt, Homo sapiens
cccgagauccugcaggcuguggg

SEQ ID NO: 1628 - RNA, 23 nt, Homo sapiens
ccgagauccugcaggcugugggc

SEQ ID NO: 1629 - RNA, 23 nt, Homo sapiens
cgagauccugcaggcugugggcg

SEQ ID NO: 1630 - RNA, 23 nt, Homo sapiens
gagauccugcaggcugugggcgg

SEQ ID NO: 1631 - RNA, 23 nt, Homo sapiens
agauccugcaggcugugggcggu

SEQ ID NO: 1632 - RNA, 23 nt, Homo sapiens
gauccugcaggcugugggcggug

SEQ ID NO: 1633 - RNA, 23 nt, Homo sapiens
auccugcaggcugugggcggugg

SEQ ID NO: 1634 - RNA, 23 nt, Homo sapiens
uccugcaggcugugggcgguggg

SEQ ID NO: 1635 - RNA, 23 nt, Homo sapiens
ccugcaggcugugggcggugggc

SEQ ID NO: 1636 - RNA, 23 nt, Homo sapiens
cugcaggcugugggcggugggcc

SEQ ID NO: 1637 - RNA, 23 nt, Homo sapiens
ugcaggcugugggcggugggccu

SEQ ID NO: 1638 - RNA, 23 nt, Homo sapiens
gcaggcugugggcggugggccug

SEQ ID NO: 1639 - RNA, 23 nt, Homo sapiens
caggcugugggcggugggccugg

SEQ ID NO: 1640 - RNA, 23 nt, Homo sapiens
aggcugugggcggugggccuggg

SEQ ID NO: 1641 - RNA, 23 nt, Homo sapiens
ggcugugggcggugggccuggga

SEQ ID NO: 1642 - RNA, 23 nt, Homo sapiens
gcugugggcggugggccugggac

SEQ ID NO: 1643 - RNA, 23 nt, Homo sapiens
cugugggcggugggccugggaca

SEQ ID NO: 1644 - RNA, 23 nt, Homo sapiens
ugugggcggugggccugggacag

SEQ ID NO: 1645 - RNA, 23 nt, Homo sapiens
gugggcggugggccugggacagg

SEQ ID NO: 1646 - RNA, 23 nt, Homo sapiens
ugggcggugggccugggacaggc

SEQ ID NO: 1647 - RNA, 23 nt, Homo sapiens
gggcggugggccugggacaggca

SEQ ID NO: 1648 - RNA, 23 nt, Homo sapiens
ggcggugggccugggacaggcag

SEQ ID NO: 1649 - RNA, 23 nt, Homo sapiens
gcggugggccugggacaggcagc

SEQ ID NO: 1650 - RNA, 23 nt, Homo sapiens
cggugggccugggacaggcagcu

SEQ ID NO: 1651 - RNA, 23 nt, Homo sapiens
ggugggccugggacaggcagcua

SEQ ID NO: 1652 - RNA, 23 nt, Homo sapiens
gugggccugggacaggcagcuac

SEQ ID NO: 1653 - RNA, 23 nt, Homo sapiens
ugggccugggacaggcagcuacg

SEQ ID NO: 1654 - RNA, 23 nt, Homo sapiens
gggccugggacaggcagcuacgg

SEQ ID NO: 1655 - RNA, 23 nt, Homo sapiens
ggccugggacaggcagcuacggg

SEQ ID NO: 1656 - RNA, 23 nt, Homo sapiens
gccugggacaggcagcuacgggc

SEQ ID NO: 1657 - RNA, 23 nt, Homo sapiens
ccugggacaggcagcuacgggcc

SEQ ID NO: 1658 - RNA, 23 nt, Homo sapiens
cugggacaggcagcuacgggccc

SEQ ID NO: 1659 - RNA, 23 nt, Homo sapiens
ugggacaggcagcuacgggcccg

SEQ ID NO: 1660 - RNA, 23 nt, Homo sapiens
gggacaggcagcuacgggcccga

SEQ ID NO: 1661 - RNA, 23 nt, Homo sapiens
ggacaggcagcuacgggcccgag

SEQ ID NO: 1662 - RNA, 23 nt, Homo sapiens
gacaggcagcuacgggcccgagu

SEQ ID NO: 1663 - RNA, 23 nt, Homo sapiens
acaggcagcuacgggcccgagug

SEQ ID NO: 1664 - RNA, 23 nt, Homo sapiens
caggcagcuacgggcccgagugu

SEQ ID NO: 1665 - RNA, 23 nt, Homo sapiens
aggcagcuacgggcccgagugug

SEQ ID NO: 1666 - RNA, 23 nt, Homo sapiens
ggcagcuacgggcccgaguguga

SEQ ID NO: 1667 - RNA, 23 nt, Homo sapiens
gcagcuacgggcccgagugugac

SEQ ID NO: 1668 - RNA, 23 nt, Homo sapiens
cagcuacgggcccgagugugacu

SEQ ID NO: 1669 - RNA, 23 nt, Homo sapiens
agcuacgggcccgagugugacug

SEQ ID NO: 1670 - RNA, 23 nt, Homo sapiens
gcuacgggcccgagugugacugg

SEQ ID NO: 1671 - RNA, 23 nt, Homo sapiens
cuacgggcccgagugugacuggu

SEQ ID NO: 1672 - RNA, 23 nt, Homo sapiens
uacgggcccgagugugacuggug

SEQ ID NO: 1673 - RNA, 23 nt, Homo sapiens
acgggcccgagugugacuggugg

SEQ ID NO: 1674 - RNA, 23 nt, Homo sapiens
cgggcccgagugugacugguggg

SEQ ID NO: 1675 - RNA, 23 nt, Homo sapiens
gggcccgagugugacuggugggc

SEQ ID NO: 1676 - RNA, 23 nt, Homo sapiens
ggcccgagugugacuggugggcg

SEQ ID NO: 1677 - RNA, 23 nt, Homo sapiens
gcccgagugugacuggugggcgc

SEQ ID NO: 1678 - RNA, 23 nt, Homo sapiens
cccgagugugacuggugggcgcu

SEQ ID NO: 1679 - RNA, 23 nt, Homo sapiens
ccgagugugacuggugggcgcug

SEQ ID NO: 1680 - RNA, 23 nt, Homo sapiens
cgagugugacuggugggcgcugg

SEQ ID NO: 1681 - RNA, 23 nt, Homo sapiens
gagugugacuggugggcgcuggg

SEQ ID NO: 1682 - RNA, 23 nt, Homo sapiens
agugugacuggugggcgcugggu

SEQ ID NO: 1683 - RNA, 23 nt, Homo sapiens
gugugacuggugggcgcugggug

SEQ ID NO: 1684 - RNA, 23 nt, Homo sapiens
ugugacuggugggcgcugggugu

SEQ ID NO: 1685 - RNA, 23 nt, Homo sapiens
gugacuggugggcgcugggugua

SEQ ID NO: 1686 - RNA, 23 nt, Homo sapiens
ugacuggugggcgcuggguguau

SEQ ID NO: 1687 - RNA, 23 nt, Homo sapiens
gacuggugggcgcuggguguauu

SEQ ID NO: 1688 - RNA, 23 nt, Homo sapiens
acuggugggcgcuggguguauuc

SEQ ID NO: 1689 - RNA, 23 nt, Homo sapiens
cuggugggcgcuggguguauucg

SEQ ID NO: 1690 - RNA, 23 nt, Homo sapiens
uggugggcgcuggguguauucgc

SEQ ID NO: 1691 - RNA, 23 nt, Homo sapiens
ggugggcgcuggguguauucgcc

SEQ ID NO: 1692 - RNA, 23 nt, Homo sapiens
gugggcgcuggguguauucgccu

SEQ ID NO: 1693 - RNA, 23 nt, Homo sapiens
ugggcgcuggguguauucgccua

SEQ ID NO: 1694 - RNA, 23 nt, Homo sapiens
gggcgcuggguguauucgccuau

SEQ ID NO: 1695 - RNA, 23 nt, Homo sapiens
ggcgcuggguguauucgccuaug

SEQ ID NO: 1696 - RNA, 23 nt, Homo sapiens
gcgcuggguguauucgccuauga

SEQ ID NO: 1697 - RNA, 23 nt, Homo sapiens
cgcuggguguauucgccuaugaa

SEQ ID NO: 1698 - RNA, 23 nt, Homo sapiens
gcuggguguauucgccuaugaaa

SEQ ID NO: 1699 - RNA, 23 nt, Homo sapiens
cuggguguauucgccuaugaaau

SEQ ID NO: 1700 - RNA, 23 nt, Homo sapiens
uggguguauucgccuaugaaaug

SEQ ID NO: 1701 - RNA, 23 nt, Homo sapiens
ggguguauucgccuaugaaaugu

SEQ ID NO: 1702 - RNA, 23 nt, Homo sapiens
gguguauucgccuaugaaauguu

SEQ ID NO: 1703 - RNA, 23 nt, Homo sapiens
guguauucgccuaugaaauguuc

SEQ ID NO: 1704 - RNA, 23 nt, Homo sapiens
uguauucgccuaugaaauguucu

SEQ ID NO: 1705 - RNA, 23 nt, Homo sapiens
guauucgccuaugaaauguucua

SEQ ID NO: 1706 - RNA, 23 nt, Homo sapiens
uauucgccuaugaaauguucuau

SEQ ID NO: 1707 - RNA, 23 nt, Homo sapiens
auucgccuaugaaauguucuaug

SEQ ID NO: 1708 - RNA, 23 nt, Homo sapiens
uucgccuaugaaauguucuaugg

SEQ ID NO: 1709 - RNA, 23 nt, Homo sapiens
ucgccuaugaaauguucuauggg

SEQ ID NO: 1710 - RNA, 23 nt, Homo sapiens
cgccuaugaaauguucuaugggc

SEQ ID NO: 1711 - RNA, 23 nt, Homo sapiens
gccuaugaaauguucuaugggca

SEQ ID NO: 1712 - RNA, 23 nt, Homo sapiens
ccuaugaaauguucuaugggcag

SEQ ID NO: 1713 - RNA, 23 nt, Homo sapiens
cuaugaaauguucuaugggcaga

SEQ ID NO: 1714 - RNA, 23 nt, Homo sapiens
uaugaaauguucuaugggcagac

SEQ ID NO: 1715 - RNA, 23 nt, Homo sapiens
augaaauguucuaugggcagacg

SEQ ID NO: 1716 - RNA, 23 nt, Homo sapiens
ugaaauguucuaugggcagacgc

SEQ ID NO: 1717 - RNA, 23 nt, Homo sapiens
gaaauguucuaugggcagacgcc

SEQ ID NO: 1718 - RNA, 23 nt, Homo sapiens
aaauguucuaugggcagacgccc

SEQ ID NO: 1719 - RNA, 23 nt, Homo sapiens
aauguucuaugggcagacgcccu

SEQ ID NO: 1720 - RNA, 23 nt, Homo sapiens
auguucuaugggcagacgcccuu

SEQ ID NO: 1721 - RNA, 23 nt, Homo sapiens
uguucuaugggcagacgcccuuc

SEQ ID NO: 1722 - RNA, 23 nt, Homo sapiens
guucuaugggcagacgcccuucu

SEQ ID NO: 1723 - RNA, 23 nt, Homo sapiens
uucuaugggcagacgcccuucua

SEQ ID NO: 1724 - RNA, 23 nt, Homo sapiens
ucuaugggcagacgcccuucuac

SEQ ID NO: 1725 - RNA, 23 nt, Homo sapiens
cuaugggcagacgcccuucuacg

SEQ ID NO: 1726 - RNA, 23 nt, Homo sapiens
uaugggcagacgcccuucuacgc

SEQ ID NO: 1727 - RNA, 23 nt, Homo sapiens
augggcagacgcccuucuacgcg

SEQ ID NO: 1728 - RNA, 23 nt, Homo sapiens
ugggcagacgcccuucuacgcgg

SEQ ID NO: 1729 - RNA, 23 nt, Homo sapiens
gggcagacgcccuucuacgcgga

SEQ ID NO: 1730 - RNA, 23 nt, Homo sapiens
ggcagacgcccuucuacgcggau

SEQ ID NO: 1731 - RNA, 23 nt, Homo sapiens
gcagacgcccuucuacgcggauu

SEQ ID NO: 1732 - RNA, 23 nt, Homo sapiens
cagacgcccuucuacgcggauuc

SEQ ID NO: 1733 - RNA, 23 nt, Homo sapiens
agacgcccuucuacgcggauucc

SEQ ID NO: 1734 - RNA, 23 nt, Homo sapiens
gacgcccuucuacgcggauucca

SEQ ID NO: 1735 - RNA, 23 nt, Homo sapiens
acgcccuucuacgcggauuccac

SEQ ID NO: 1736 - RNA, 23 nt, Homo sapiens
cgcccuucuacgcggauuccacg

SEQ ID NO: 1737 - RNA, 23 nt, Homo sapiens
gcccuucuacgcggauuccacgg

SEQ ID NO: 1738 - RNA, 23 nt, Homo sapiens
cccuucuacgcggauuccacggc

SEQ ID NO: 1739 - RNA, 23 nt, Homo sapiens
ccuucuacgcggauuccacggcg

SEQ ID NO: 1740 - RNA, 23 nt, Homo sapiens
cuucuacgcggauuccacggcgg

SEQ ID NO: 1741 - RNA, 23 nt, Homo sapiens
uucuacgcggauuccacggcgga

SEQ ID NO: 1742 - RNA, 23 nt, Homo sapiens
ucuacgcggauuccacggcggag

SEQ ID NO: 1743 - RNA, 23 nt, Homo sapiens
cuacgcggauuccacggcggaga

SEQ ID NO: 1744 - RNA, 23 nt, Homo sapiens
uacgcggauuccacggcggagac

SEQ ID NO: 1745 - RNA, 23 nt, Homo sapiens
acgcggauuccacggcggagacc

SEQ ID NO: 1746 - RNA, 23 nt, Homo sapiens
cgcggauuccacggcggagaccu

SEQ ID NO: 1747 - RNA, 23 nt, Homo sapiens
gcggauuccacggcggagaccua

SEQ ID NO: 1748 - RNA, 23 nt, Homo sapiens
cggauuccacggcggagaccuau

SEQ ID NO: 1749 - RNA, 23 nt, Homo sapiens
ggauuccacggcggagaccuaug

SEQ ID NO: 1750 - RNA, 23 nt, Homo sapiens
gauuccacggcggagaccuaugg

SEQ ID NO: 1751 - RNA, 23 nt, Homo sapiens
auuccacggcggagaccuauggc

SEQ ID NO: 1752 - RNA, 23 nt, Homo sapiens
uuccacggcggagaccuauggca

SEQ ID NO: 1753 - RNA, 23 nt, Homo sapiens
uccacggcggagaccuauggcaa

SEQ ID NO: 1754 - RNA, 23 nt, Homo sapiens
ccacggcggagaccuauggcaag

SEQ ID NO: 1755 - RNA, 23 nt, Homo sapiens
cacggcggagaccuauggcaaga

SEQ ID NO: 1756 - RNA, 23 nt, Homo sapiens
acggcggagaccuauggcaagau

SEQ ID NO: 1757 - RNA, 23 nt, Homo sapiens
cggcggagaccuauggcaagauc

SEQ ID NO: 1758 - RNA, 23 nt, Homo sapiens
ggcggagaccuauggcaagaucg

SEQ ID NO: 1759 - RNA, 23 nt, Homo sapiens
gcggagaccuauggcaagaucgu

SEQ ID NO: 1760 - RNA, 23 nt, Homo sapiens
cggagaccuauggcaagaucguc

SEQ ID NO: 1761 - RNA, 23 nt, Homo sapiens
ggagaccuauggcaagaucgucc

SEQ ID NO: 1762 - RNA, 23 nt, Homo sapiens
gagaccuauggcaagaucgucca

SEQ ID NO: 1763 - RNA, 23 nt, Homo sapiens
agaccuauggcaagaucguccac

SEQ ID NO: 1764 - RNA, 23 nt, Homo sapiens
gaccuauggcaagaucguccacu

SEQ ID NO: 1765 - RNA, 23 nt, Homo sapiens
accuauggcaagaucguccacua

SEQ ID NO: 1766 - RNA, 23 nt, Homo sapiens
ccuauggcaagaucguccacuac

SEQ ID NO: 1767 - RNA, 23 nt, Homo sapiens
cuauggcaagaucguccacuaca

SEQ ID NO: 1768 - RNA, 23 nt, Homo sapiens
uauggcaagaucguccacuacaa

SEQ ID NO: 1769 - RNA, 23 nt, Homo sapiens
auggcaagaucguccacuacaag

SEQ ID NO: 1770 - RNA, 23 nt, Homo sapiens
uggcaagaucguccacuacaagg

SEQ ID NO: 1771 - RNA, 23 nt, Homo sapiens
ggcaagaucguccacuacaagga

SEQ ID NO: 1772 - RNA, 23 nt, Homo sapiens
gcaagaucguccacuacaaggag

SEQ ID NO: 1773 - RNA, 23 nt, Homo sapiens
caagaucguccacuacaaggagc

SEQ ID NO: 1774 - RNA, 23 nt, Homo sapiens
aagaucguccacuacaaggagca

SEQ ID NO: 1775 - RNA, 23 nt, Homo sapiens
agaucguccacuacaaggagcac

SEQ ID NO: 1776 - RNA, 23 nt, Homo sapiens
gaucguccacuacaaggagcacc

SEQ ID NO: 1777 - RNA, 23 nt, Homo sapiens
aucguccacuacaaggagcaccu

SEQ ID NO: 1778 - RNA, 23 nt, Homo sapiens
ucguccacuacaaggagcaccuc

SEQ ID NO: 1779 - RNA, 23 nt, Homo sapiens
cguccacuacaaggagcaccucu

SEQ ID NO: 1780 - RNA, 23 nt, Homo sapiens
guccacuacaaggagcaccucuc

SEQ ID NO: 1781 - RNA, 23 nt, Homo sapiens
uccacuacaaggagcaccucucu

SEQ ID NO: 1782 - RNA, 23 nt, Homo sapiens
ccacuacaaggagcaccucucuc

SEQ ID NO: 1783 - RNA, 23 nt, Homo sapiens
cacuacaaggagcaccucucucu

SEQ ID NO: 1784 - RNA, 23 nt, Homo sapiens
acuacaaggagcaccucucucug

SEQ ID NO: 1785 - RNA, 23 nt, Homo sapiens
cuacaaggagcaccucucucugc

SEQ ID NO: 1786 - RNA, 23 nt, Homo sapiens
uacaaggagcaccucucucugcc

SEQ ID NO: 1787 - RNA, 23 nt, Homo sapiens
acaaggagcaccucucucugccg

SEQ ID NO: 1788 - RNA, 23 nt, Homo sapiens
caaggagcaccucucucugccgc

SEQ ID NO: 1789 - RNA, 23 nt, Homo sapiens
aaggagcaccucucucugccgcu

SEQ ID NO: 1790 - RNA, 23 nt, Homo sapiens
aggagcaccucucucugccgcug

SEQ ID NO: 1791 - RNA, 23 nt, Homo sapiens
ggagcaccucucucugccgcugg

SEQ ID NO: 1792 - RNA, 23 nt, Homo sapiens
gagcaccucucucugccgcuggu

SEQ ID NO: 1793 - RNA, 23 nt, Homo sapiens
agcaccucucucugccgcuggug

SEQ ID NO: 1794 - RNA, 23 nt, Homo sapiens
gcaccucucucugccgcuggugg

SEQ ID NO: 1795 - RNA, 23 nt, Homo sapiens
caccucucucugccgcuggugga

SEQ ID NO: 1796 - RNA, 23 nt, Homo sapiens
accucucucugccgcugguggac

SEQ ID NO: 1797 - RNA, 23 nt, Homo sapiens
ccucucucugccgcugguggacg

SEQ ID NO: 1798 - RNA, 23 nt, Homo sapiens
cucucucugccgcugguggacga

SEQ ID NO: 1799 - RNA, 23 nt, Homo sapiens
ucucucugccgcugguggacgaa

SEQ ID NO: 1800 - RNA, 23 nt, Homo sapiens
cucucugccgcugguggacgaag

SEQ ID NO: 1801 - RNA, 23 nt, Homo sapiens
ucucugccgcugguggacgaagg

SEQ ID NO: 1802 - RNA, 23 nt, Homo sapiens
cucugccgcugguggacgaaggg

SEQ ID NO: 1803 - RNA, 23 nt, Homo sapiens
ucugccgcugguggacgaagggg

SEQ ID NO: 1804 - RNA, 23 nt, Homo sapiens
cugccgcugguggacgaaggggu

SEQ ID NO: 1805 - RNA, 23 nt, Homo sapiens
ugccgcugguggacgaagggguc

SEQ ID NO: 1806 - RNA, 23 nt, Homo sapiens
gccgcugguggacgaaggggucc

SEQ ID NO: 1807 - RNA, 23 nt, Homo sapiens
ccgcugguggacgaagggguccc

SEQ ID NO: 1808 - RNA, 23 nt, Homo sapiens
cgcugguggacgaaggggucccu

SEQ ID NO: 1809 - RNA, 23 nt, Homo sapiens
gcugguggacgaaggggucccug

SEQ ID NO: 1810 - RNA, 23 nt, Homo sapiens
cugguggacgaaggggucccuga

SEQ ID NO: 1811 - RNA, 23 nt, Homo sapiens
ugguggacgaaggggucccugag

SEQ ID NO: 1812 - RNA, 23 nt, Homo sapiens
gguggacgaaggggucccugagg

SEQ ID NO: 1813 - RNA, 23 nt, Homo sapiens
guggacgaaggggucccugagga

SEQ ID NO: 1814 - RNA, 23 nt, Homo sapiens
uggacgaaggggucccugaggag

SEQ ID NO: 1815 - RNA, 23 nt, Homo sapiens
ggacgaaggggucccugaggagg

SEQ ID NO: 1816 - RNA, 23 nt, Homo sapiens
gacgaaggggucccugaggaggc

SEQ ID NO: 1817 - RNA, 23 nt, Homo sapiens
acgaaggggucccugaggaggcu

SEQ ID NO: 1818 - RNA, 23 nt, Homo sapiens
cgaaggggucccugaggaggcuc

SEQ ID NO: 1819 - RNA, 23 nt, Homo sapiens
gaaggggucccugaggaggcucg

SEQ ID NO: 1820 - RNA, 23 nt, Homo sapiens
aaggggucccugaggaggcucga

SEQ ID NO: 1821 - RNA, 23 nt, Homo sapiens
aggggucccugaggaggcucgag

SEQ ID NO: 1822 - RNA, 23 nt, Homo sapiens
ggggucccugaggaggcucgaga

SEQ ID NO: 1823 - RNA, 23 nt, Homo sapiens
gggucccugaggaggcucgagac

SEQ ID NO: 1824 - RNA, 23 nt, Homo sapiens
ggucccugaggaggcucgagacu

SEQ ID NO: 1825 - RNA, 23 nt, Homo sapiens
gucccugaggaggcucgagacuu

SEQ ID NO: 1826 - RNA, 23 nt, Homo sapiens
ucccugaggaggcucgagacuuc

SEQ ID NO: 1827 - RNA, 23 nt, Homo sapiens
cccugaggaggcucgagacuuca

SEQ ID NO: 1828 - RNA, 23 nt, Homo sapiens
ccugaggaggcucgagacuucau

SEQ ID NO: 1829 - RNA, 23 nt, Homo sapiens
cugaggaggcucgagacuucauu

SEQ ID NO: 1830 - RNA, 23 nt, Homo sapiens
ugaggaggcucgagacuucauuc

SEQ ID NO: 1831 - RNA, 23 nt, Homo sapiens
gaggaggcucgagacuucauuca

SEQ ID NO: 1832 - RNA, 23 nt, Homo sapiens
aggaggcucgagacuucauucag

SEQ ID NO: 1833 - RNA, 23 nt, Homo sapiens
ggaggcucgagacuucauucagc

SEQ ID NO: 1834 - RNA, 23 nt, Homo sapiens
gaggcucgagacuucauucagcg

SEQ ID NO: 1835 - RNA, 23 nt, Homo sapiens
aggcucgagacuucauucagcgg

SEQ ID NO: 1836 - RNA, 23 nt, Homo sapiens
ggcucgagacuucauucagcggu

SEQ ID NO: 1837 - RNA, 23 nt, Homo sapiens
gcucgagacuucauucagcgguu

SEQ ID NO: 1838 - RNA, 23 nt, Homo sapiens
cucgagacuucauucagcgguug

SEQ ID NO: 1839 - RNA, 23 nt, Homo sapiens
ucgagacuucauucagcgguugc

SEQ ID NO: 1840 - RNA, 23 nt, Homo sapiens
cgagacuucauucagcgguugcu

SEQ ID NO: 1841 - RNA, 23 nt, Homo sapiens
gagacuucauucagcgguugcug

SEQ ID NO: 1842 - RNA, 23 nt, Homo sapiens
agacuucauucagcgguugcugu

SEQ ID NO: 1843 - RNA, 23 nt, Homo sapiens
gacuucauucagcgguugcugug

SEQ ID NO: 1844 - RNA, 23 nt, Homo sapiens
acuucauucagcgguugcugugu

SEQ ID NO: 1845 - RNA, 23 nt, Homo sapiens
cuucauucagcgguugcuguguc

SEQ ID NO: 1846 - RNA, 23 nt, Homo sapiens
uucauucagcgguugcugugucc

SEQ ID NO: 1847 - RNA, 23 nt, Homo sapiens
ucauucagcgguugcuguguccc

SEQ ID NO: 1848 - RNA, 23 nt, Homo sapiens
cauucagcgguugcugugucccc

SEQ ID NO: 1849 - RNA, 23 nt, Homo sapiens
auucagcgguugcuguguccccc

SEQ ID NO: 1850 - RNA, 23 nt, Homo sapiens
uucagcgguugcugugucccccg

SEQ ID NO: 1851 - RNA, 23 nt, Homo sapiens
ucagcgguugcugugucccccgg

SEQ ID NO: 1852 - RNA, 23 nt, Homo sapiens
cagcgguugcugugucccccgga

SEQ ID NO: 1853 - RNA, 23 nt, Homo sapiens
agcgguugcugugucccccggag

SEQ ID NO: 1854 - RNA, 23 nt, Homo sapiens
gcgguugcugugucccccggaga

SEQ ID NO: 1855 - RNA, 23 nt, Homo sapiens
cgguugcugugucccccggagac

SEQ ID NO: 1856 - RNA, 23 nt, Homo sapiens
gguugcugugucccccggagaca

SEQ ID NO: 1857 - RNA, 23 nt, Homo sapiens
guugcugugucccccggagacac

SEQ ID NO: 1858 - RNA, 23 nt, Homo sapiens
uugcugugucccccggagacacg

SEQ ID NO: 1859 - RNA, 23 nt, Homo sapiens
ugcugugucccccggagacacgg

SEQ ID NO: 1860 - RNA, 23 nt, Homo sapiens
gcugugucccccggagacacggc

SEQ ID NO: 1861 - RNA, 23 nt, Homo sapiens
cugugucccccggagacacggcu

SEQ ID NO: 1862 - RNA, 23 nt, Homo sapiens
ugugucccccggagacacggcug

SEQ ID NO: 1863 - RNA, 23 nt, Homo sapiens
gugucccccggagacacggcugg

SEQ ID NO: 1864 - RNA, 23 nt, Homo sapiens
ugucccccggagacacggcuggg

SEQ ID NO: 1865 - RNA, 23 nt, Homo sapiens
gucccccggagacacggcugggc

SEQ ID NO: 1866 - RNA, 23 nt, Homo sapiens
ucccccggagacacggcugggcc

SEQ ID NO: 1867 - RNA, 23 nt, Homo sapiens
cccccggagacacggcugggccg

SEQ ID NO: 1868 - RNA, 23 nt, Homo sapiens
ccccggagacacggcugggccgg

SEQ ID NO: 1869 - RNA, 23 nt, Homo sapiens
cccggagacacggcugggccggg

SEQ ID NO: 1870 - RNA, 23 nt, Homo sapiens
ccggagacacggcugggccgggg

SEQ ID NO: 1871 - RNA, 23 nt, Homo sapiens
cggagacacggcugggccggggu

SEQ ID NO: 1872 - RNA, 23 nt, Homo sapiens
ggagacacggcugggccggggug

SEQ ID NO: 1873 - RNA, 23 nt, Homo sapiens
gagacacggcugggccggggugg

SEQ ID NO: 1874 - RNA, 23 nt, Homo sapiens
agacacggcugggccggggugga

SEQ ID NO: 1875 - RNA, 23 nt, Homo sapiens
gacacggcugggccgggguggag

SEQ ID NO: 1876 - RNA, 23 nt, Homo sapiens
acacggcugggccgggguggagc

SEQ ID NO: 1877 - RNA, 23 nt, Homo sapiens
cacggcugggccgggguggagca

SEQ ID NO: 1878 - RNA, 23 nt, Homo sapiens
acggcugggccgggguggagcag

SEQ ID NO: 1879 - RNA, 23 nt, Homo sapiens
cggcugggccgggguggagcagg

SEQ ID NO: 1880 - RNA, 23 nt, Homo sapiens
ggcugggccgggguggagcaggc

SEQ ID NO: 1881 - RNA, 23 nt, Homo sapiens
gcugggccgggguggagcaggcg

SEQ ID NO: 1882 - RNA, 23 nt, Homo sapiens
cugggccgggguggagcaggcga

SEQ ID NO: 1883 - RNA, 23 nt, Homo sapiens
ugggccgggguggagcaggcgac

SEQ ID NO: 1884 - RNA, 23 nt, Homo sapiens
gggccgggguggagcaggcgacu

SEQ ID NO: 1885 - RNA, 23 nt, Homo sapiens
ggccgggguggagcaggcgacuu

SEQ ID NO: 1886 - RNA, 23 nt, Homo sapiens
gccgggguggagcaggcgacuuc

SEQ ID NO: 1887 - RNA, 23 nt, Homo sapiens
ccgggguggagcaggcgacuucc

SEQ ID NO: 1888 - RNA, 23 nt, Homo sapiens
cgggguggagcaggcgacuuccg

SEQ ID NO: 1889 - RNA, 23 nt, Homo sapiens
gggguggagcaggcgacuuccgg

SEQ ID NO: 1890 - RNA, 23 nt, Homo sapiens
ggguggagcaggcgacuuccgga

SEQ ID NO: 1891 - RNA, 23 nt, Homo sapiens
gguggagcaggcgacuuccggac

SEQ ID NO: 1892 - RNA, 23 nt, Homo sapiens
guggagcaggcgacuuccggaca

SEQ ID NO: 1893 - RNA, 23 nt, Homo sapiens
uggagcaggcgacuuccggacac

SEQ ID NO: 1894 - RNA, 23 nt, Homo sapiens
ggagcaggcgacuuccggacaca

SEQ ID NO: 1895 - RNA, 23 nt, Homo sapiens
gagcaggcgacuuccggacacau

SEQ ID NO: 1896 - RNA, 23 nt, Homo sapiens
agcaggcgacuuccggacacauc

SEQ ID NO: 1897 - RNA, 23 nt, Homo sapiens
gcaggcgacuuccggacacaucc

SEQ ID NO: 1898 - RNA, 23 nt, Homo sapiens
caggcgacuuccggacacauccc

SEQ ID NO: 1899 - RNA, 23 nt, Homo sapiens
aggcgacuuccggacacaucccu

SEQ ID NO: 1900 - RNA, 23 nt, Homo sapiens
ggcgacuuccggacacaucccuu

SEQ ID NO: 1901 - RNA, 23 nt, Homo sapiens
gcgacuuccggacacaucccuuc

SEQ ID NO: 1902 - RNA, 23 nt, Homo sapiens
cgacuuccggacacaucccuucu

SEQ ID NO: 1903 - RNA, 23 nt, Homo sapiens
gacuuccggacacaucccuucuu

SEQ ID NO: 1904 - RNA, 23 nt, Homo sapiens
acuuccggacacaucccuucuuc

SEQ ID NO: 1905 - RNA, 23 nt, Homo sapiens
cuuccggacacaucccuucuucu

SEQ ID NO: 1906 - RNA, 23 nt, Homo sapiens
uuccggacacaucccuucuucuu

SEQ ID NO: 1907 - RNA, 23 nt, Homo sapiens
uccggacacaucccuucuucuuu

SEQ ID NO: 1908 - RNA, 23 nt, Homo sapiens
ccggacacaucccuucuucuuug

SEQ ID NO: 1909 - RNA, 23 nt, Homo sapiens
cggacacaucccuucuucuuugg

SEQ ID NO: 1910 - RNA, 23 nt, Homo sapiens
ggacacaucccuucuucuuuggc

SEQ ID NO: 1911 - RNA, 23 nt, Homo sapiens
gacacaucccuucuucuuuggcc

SEQ ID NO: 1912 - RNA, 23 nt, Homo sapiens
acacaucccuucuucuuuggccu

SEQ ID NO: 1913 - RNA, 23 nt, Homo sapiens
cacaucccuucuucuuuggccuc

SEQ ID NO: 1914 - RNA, 23 nt, Homo sapiens
acaucccuucuucuuuggccucg

SEQ ID NO: 1915 - RNA, 23 nt, Homo sapiens
caucccuucuucuuuggccucga

SEQ ID NO: 1916 - RNA, 23 nt, Homo sapiens
aucccuucuucuuuggccucgac

SEQ ID NO: 1917 - RNA, 23 nt, Homo sapiens
ucccuucuucuuuggccucgacu

SEQ ID NO: 1918 - RNA, 23 nt, Homo sapiens
cccuucuucuuuggccucgacug

SEQ ID NO: 1919 - RNA, 23 nt, Homo sapiens
ccuucuucuuuggccucgacugg

SEQ ID NO: 1920 - RNA, 23 nt, Homo sapiens
cuucuucuuuggccucgacuggg

SEQ ID NO: 1921 - RNA, 23 nt, Homo sapiens
uucuucuuuggccucgacuggga

SEQ ID NO: 1922 - RNA, 23 nt, Homo sapiens
ucuucuuuggccucgacugggau

SEQ ID NO: 1923 - RNA, 23 nt, Homo sapiens
cuucuuuggccucgacugggaug

SEQ ID NO: 1924 - RNA, 23 nt, Homo sapiens
uucuuuggccucgacugggaugg

SEQ ID NO: 1925 - RNA, 23 nt, Homo sapiens
ucuuuggccucgacugggauggu

SEQ ID NO: 1926 - RNA, 23 nt, Homo sapiens
cuuuggccucgacugggaugguc

SEQ ID NO: 1927 - RNA, 23 nt, Homo sapiens
uuuggccucgacugggauggucu

SEQ ID NO: 1928 - RNA, 23 nt, Homo sapiens
uuggccucgacugggauggucuc

SEQ ID NO: 1929 - RNA, 23 nt, Homo sapiens
uggccucgacugggauggucucc

SEQ ID NO: 1930 - RNA, 23 nt, Homo sapiens
ggccucgacugggauggucuccg

SEQ ID NO: 1931 - RNA, 23 nt, Homo sapiens
gccucgacugggauggucuccgg

SEQ ID NO: 1932 - RNA, 23 nt, Homo sapiens
ccucgacugggauggucuccggg

SEQ ID NO: 1933 - RNA, 23 nt, Homo sapiens
cucgacugggauggucuccggga

SEQ ID NO: 1934 - RNA, 23 nt, Homo sapiens
ucgacugggauggucuccgggac

SEQ ID NO: 1935 - RNA, 23 nt, Homo sapiens
cgacugggauggucuccgggaca

SEQ ID NO: 1936 - RNA, 23 nt, Homo sapiens
gacugggauggucuccgggacag

SEQ ID NO: 1937 - RNA, 23 nt, Homo sapiens
acugggauggucuccgggacagc

SEQ ID NO: 1938 - RNA, 23 nt, Homo sapiens
cugggauggucuccgggacagcg

SEQ ID NO: 1939 - RNA, 23 nt, Homo sapiens
ugggauggucuccgggacagcgu

SEQ ID NO: 1940 - RNA, 23 nt, Homo sapiens
gggauggucuccgggacagcgug

SEQ ID NO: 1941 - RNA, 23 nt, Homo sapiens
ggauggucuccgggacagcgugc

SEQ ID NO: 1942 - RNA, 23 nt, Homo sapiens
gauggucuccgggacagcgugcc

SEQ ID NO: 1943 - RNA, 23 nt, Homo sapiens
auggucuccgggacagcgugccc

SEQ ID NO: 1944 - RNA, 23 nt, Homo sapiens
uggucuccgggacagcgugcccc

SEQ ID NO: 1945 - RNA, 23 nt, Homo sapiens
ggucuccgggacagcgugccccc

SEQ ID NO: 1946 - RNA, 23 nt, Homo sapiens
gucuccgggacagcgugcccccc

SEQ ID NO: 1947 - RNA, 23 nt, Homo sapiens
ucuccgggacagcgugccccccu

SEQ ID NO: 1948 - RNA, 23 nt, Homo sapiens
cuccgggacagcgugccccccuu

SEQ ID NO: 1949 - RNA, 23 nt, Homo sapiens
uccgggacagcgugccccccuuu

SEQ ID NO: 1950 - RNA, 23 nt, Homo sapiens
ccgggacagcgugccccccuuua

SEQ ID NO: 1951 - RNA, 23 nt, Homo sapiens
cgggacagcgugccccccuuuac

SEQ ID NO: 1952 - RNA, 23 nt, Homo sapiens
gggacagcgugccccccuuuaca

SEQ ID NO: 1953 - RNA, 23 nt, Homo sapiens
ggacagcgugccccccuuuacac

SEQ ID NO: 1954 - RNA, 23 nt, Homo sapiens
gacagcgugccccccuuuacacc

SEQ ID NO: 1955 - RNA, 23 nt, Homo sapiens
acagcgugccccccuuuacaccg

SEQ ID NO: 1956 - RNA, 23 nt, Homo sapiens
cagcgugccccccuuuacaccgg

SEQ ID NO: 1957 - RNA, 23 nt, Homo sapiens
agcgugccccccuuuacaccgga

SEQ ID NO: 1958 - RNA, 23 nt, Homo sapiens
gcgugccccccuuuacaccggau

SEQ ID NO: 1959 - RNA, 23 nt, Homo sapiens
cgugccccccuuuacaccggauu

SEQ ID NO: 1960 - RNA, 23 nt, Homo sapiens
gugccccccuuuacaccggauuu

SEQ ID NO: 1961 - RNA, 23 nt, Homo sapiens
ugccccccuuuacaccggauuuc

SEQ ID NO: 1962 - RNA, 23 nt, Homo sapiens
gccccccuuuacaccggauuucg

SEQ ID NO: 1963 - RNA, 23 nt, Homo sapiens
ccccccuuuacaccggauuucga

SEQ ID NO: 1964 - RNA, 23 nt, Homo sapiens
cccccuuuacaccggauuucgaa

SEQ ID NO: 1965 - RNA, 23 nt, Homo sapiens
ccccuuuacaccggauuucgaag

SEQ ID NO: 1966 - RNA, 23 nt, Homo sapiens
cccuuuacaccggauuucgaagg

SEQ ID NO: 1967 - RNA, 23 nt, Homo sapiens
ccuuuacaccggauuucgaaggu

SEQ ID NO: 1968 - RNA, 23 nt, Homo sapiens
cuuuacaccggauuucgaaggug

SEQ ID NO: 1969 - RNA, 23 nt, Homo sapiens
uuuacaccggauuucgaaggugc

SEQ ID NO: 1970 - RNA, 23 nt, Homo sapiens
uuacaccggauuucgaaggugcc

SEQ ID NO: 1971 - RNA, 23 nt, Homo sapiens
uacaccggauuucgaaggugcca

SEQ ID NO: 1972 - RNA, 23 nt, Homo sapiens
acaccggauuucgaaggugccac

SEQ ID NO: 1973 - RNA, 23 nt, Homo sapiens
caccggauuucgaaggugccacc

SEQ ID NO: 1974 - RNA, 23 nt, Homo sapiens
accggauuucgaaggugccaccg

SEQ ID NO: 1975 - RNA, 23 nt, Homo sapiens
ccggauuucgaaggugccaccga

SEQ ID NO: 1976 - RNA, 23 nt, Homo sapiens
cggauuucgaaggugccaccgac

SEQ ID NO: 1977 - RNA, 23 nt, Homo sapiens
ggauuucgaaggugccaccgaca

SEQ ID NO: 1978 - RNA, 23 nt, Homo sapiens
gauuucgaaggugccaccgacac

SEQ ID NO: 1979 - RNA, 23 nt, Homo sapiens
auuucgaaggugccaccgacaca

SEQ ID NO: 1980 - RNA, 23 nt, Homo sapiens
uuucgaaggugccaccgacacau

SEQ ID NO: 1981 - RNA, 23 nt, Homo sapiens
uucgaaggugccaccgacacaug

SEQ ID NO: 1982 - RNA, 23 nt, Homo sapiens
ucgaaggugccaccgacacaugc

SEQ ID NO: 1983 - RNA, 23 nt, Homo sapiens
cgaaggugccaccgacacaugca

SEQ ID NO: 1984 - RNA, 23 nt, Homo sapiens
gaaggugccaccgacacaugcaa

SEQ ID NO: 1985 - RNA, 23 nt, Homo sapiens
aaggugccaccgacacaugcaac

SEQ ID NO: 1986 - RNA, 23 nt, Homo sapiens
aggugccaccgacacaugcaacu

SEQ ID NO: 1987 - RNA, 23 nt, Homo sapiens
ggugccaccgacacaugcaacuu

SEQ ID NO: 1988 - RNA, 23 nt, Homo sapiens
gugccaccgacacaugcaacuuc

SEQ ID NO: 1989 - RNA, 23 nt, Homo sapiens
ugccaccgacacaugcaacuucg

SEQ ID NO: 1990 - RNA, 23 nt, Homo sapiens
gccaccgacacaugcaacuucga

SEQ ID NO: 1991 - RNA, 23 nt, Homo sapiens
ccaccgacacaugcaacuucgac

SEQ ID NO: 1992 - RNA, 23 nt, Homo sapiens
caccgacacaugcaacuucgacu

SEQ ID NO: 1993 - RNA, 23 nt, Homo sapiens
accgacacaugcaacuucgacuu

SEQ ID NO: 1994 - RNA, 23 nt, Homo sapiens
ccgacacaugcaacuucgacuug

SEQ ID NO: 1995 - RNA, 23 nt, Homo sapiens
cgacacaugcaacuucgacuugg

SEQ ID NO: 1996 - RNA, 23 nt, Homo sapiens
gacacaugcaacuucgacuuggu

SEQ ID NO: 1997 - RNA, 23 nt, Homo sapiens
acacaugcaacuucgacuuggug

SEQ ID NO: 1998 - RNA, 23 nt, Homo sapiens
cacaugcaacuucgacuuggugg

SEQ ID NO: 1999 - RNA, 23 nt, Homo sapiens
acaugcaacuucgacuuggugga

SEQ ID NO: 2000 - RNA, 23 nt, Homo sapiens
caugcaacuucgacuugguggag

SEQ ID NO: 2001 - RNA, 23 nt, Homo sapiens
augcaacuucgacuugguggagg

SEQ ID NO: 2002 - RNA, 23 nt, Homo sapiens
ugcaacuucgacuugguggagga

SEQ ID NO: 2003 - RNA, 23 nt, Homo sapiens
gcaacuucgacuugguggaggac

SEQ ID NO: 2004 - RNA, 23 nt, Homo sapiens
caacuucgacuugguggaggacg

SEQ ID NO: 2005 - RNA, 23 nt, Homo sapiens
aacuucgacuugguggaggacgg

SEQ ID NO: 2006 - RNA, 23 nt, Homo sapiens
acuucgacuugguggaggacggg

SEQ ID NO: 2007 - RNA, 23 nt, Homo sapiens
cuucgacuugguggaggacgggc

SEQ ID NO: 2008 - RNA, 23 nt, Homo sapiens
uucgacuugguggaggacgggcu

SEQ ID NO: 2009 - RNA, 23 nt, Homo sapiens
ucgacuugguggaggacgggcuc

SEQ ID NO: 2010 - RNA, 23 nt, Homo sapiens
cgacuugguggaggacgggcuca

SEQ ID NO: 2011 - RNA, 23 nt, Homo sapiens
gacuugguggaggacgggcucac

SEQ ID NO: 2012 - RNA, 23 nt, Homo sapiens
acuugguggaggacgggcucacu

SEQ ID NO: 2013 - RNA, 23 nt, Homo sapiens
cuugguggaggacgggcucacug

SEQ ID NO: 2014 - RNA, 23 nt, Homo sapiens
uugguggaggacgggcucacugc

SEQ ID NO: 2015 - RNA, 23 nt, Homo sapiens
ugguggaggacgggcucacugcc

SEQ ID NO: 2016 - RNA, 23 nt, Homo sapiens
gguggaggacgggcucacugcca

SEQ ID NO: 2017 - RNA, 23 nt, Homo sapiens
guggaggacgggcucacugccau

SEQ ID NO: 2018 - RNA, 23 nt, Homo sapiens
uggaggacgggcucacugccaug

SEQ ID NO: 2019 - RNA, 23 nt, Homo sapiens
ggaggacgggcucacugccaugg

SEQ ID NO: 2020 - RNA, 23 nt, Homo sapiens
gaggacgggcucacugccaugga

SEQ ID NO: 2021 - RNA, 23 nt, Homo sapiens
aggacgggcucacugccauggag

SEQ ID NO: 2022 - RNA, 23 nt, Homo sapiens
ggacgggcucacugccauggaga

SEQ ID NO: 2023 - RNA, 23 nt, Homo sapiens
gacgggcucacugccauggagac

SEQ ID NO: 2024 - RNA, 23 nt, Homo sapiens
acgggcucacugccauggagaca

SEQ ID NO: 2025 - RNA, 23 nt, Homo sapiens
cgggcucacugccauggagacac

SEQ ID NO: 2026 - RNA, 23 nt, Homo sapiens
gggcucacugccauggagacacu

SEQ ID NO: 2027 - RNA, 23 nt, Homo sapiens
ggcucacugccauggagacacug

SEQ ID NO: 2028 - RNA, 23 nt, Homo sapiens
gcucacugccauggagacacugu

SEQ ID NO: 2029 - RNA, 23 nt, Homo sapiens
cucacugccauggagacacuguc

SEQ ID NO: 2030 - RNA, 23 nt, Homo sapiens
ucacugccauggagacacugucg

SEQ ID NO: 2031 - RNA, 23 nt, Homo sapiens
cacugccauggagacacugucgg

SEQ ID NO: 2032 - RNA, 23 nt, Homo sapiens
acugccauggagacacugucgga

SEQ ID NO: 2033 - RNA, 23 nt, Homo sapiens
cugccauggagacacugucggac

SEQ ID NO: 2034 - RNA, 23 nt, Homo sapiens
ugccauggagacacugucggaca

SEQ ID NO: 2035 - RNA, 23 nt, Homo sapiens
gccauggagacacugucggacau

SEQ ID NO: 2036 - RNA, 23 nt, Homo sapiens
ccauggagacacugucggacauu

SEQ ID NO: 2037 - RNA, 23 nt, Homo sapiens
cauggagacacugucggacauuc

SEQ ID NO: 2038 - RNA, 23 nt, Homo sapiens
auggagacacugucggacauucg

SEQ ID NO: 2039 - RNA, 23 nt, Homo sapiens
uggagacacugucggacauucgg

SEQ ID NO: 2040 - RNA, 23 nt, Homo sapiens
ggagacacugucggacauucggg

SEQ ID NO: 2041 - RNA, 23 nt, Homo sapiens
gagacacugucggacauucggga

SEQ ID NO: 2042 - RNA, 23 nt, Homo sapiens
agacacugucggacauucgggaa

SEQ ID NO: 2043 - RNA, 23 nt, Homo sapiens
gacacugucggacauucgggaag

SEQ ID NO: 2044 - RNA, 23 nt, Homo sapiens
acacugucggacauucgggaagg

SEQ ID NO: 2045 - RNA, 23 nt, Homo sapiens
cacugucggacauucgggaaggu

SEQ ID NO: 2046 - RNA, 23 nt, Homo sapiens
acugucggacauucgggaaggug

SEQ ID NO: 2047 - RNA, 23 nt, Homo sapiens
cugucggacauucgggaaggugc

SEQ ID NO: 2048 - RNA, 23 nt, Homo sapiens
ugucggacauucgggaaggugcg

SEQ ID NO: 2049 - RNA, 23 nt, Homo sapiens
gucggacauucgggaaggugcgc

SEQ ID NO: 2050 - RNA, 23 nt, Homo sapiens
ucggacauucgggaaggugcgcc

SEQ ID NO: 2051 - RNA, 23 nt, Homo sapiens
cggacauucgggaaggugcgccg

SEQ ID NO: 2052 - RNA, 23 nt, Homo sapiens
ggacauucgggaaggugcgccgc

SEQ ID NO: 2053 - RNA, 23 nt, Homo sapiens
gacauucgggaaggugcgccgcu

SEQ ID NO: 2054 - RNA, 23 nt, Homo sapiens
acauucgggaaggugcgccgcua

SEQ ID NO: 2055 - RNA, 23 nt, Homo sapiens
cauucgggaaggugcgccgcuag

SEQ ID NO: 2056 - RNA, 23 nt, Homo sapiens
auucgggaaggugcgccgcuagg

SEQ ID NO: 2057 - RNA, 23 nt, Homo sapiens
uucgggaaggugcgccgcuaggg

SEQ ID NO: 2058 - RNA, 23 nt, Homo sapiens
ucgggaaggugcgccgcuagggg

SEQ ID NO: 2059 - RNA, 23 nt, Homo sapiens
cgggaaggugcgccgcuaggggu

SEQ ID NO: 2060 - RNA, 23 nt, Homo sapiens
gggaaggugcgccgcuagggguc

SEQ ID NO: 2061 - RNA, 23 nt, Homo sapiens
ggaaggugcgccgcuaggggucc

SEQ ID NO: 2062 - RNA, 23 nt, Homo sapiens
gaaggugcgccgcuaggggucca

SEQ ID NO: 2063 - RNA, 23 nt, Homo sapiens
aaggugcgccgcuagggguccac

SEQ ID NO: 2064 - RNA, 23 nt, Homo sapiens
aggugcgccgcuagggguccacc

SEQ ID NO: 2065 - RNA, 23 nt, Homo sapiens
ggugcgccgcuagggguccaccu

SEQ ID NO: 2066 - RNA, 23 nt, Homo sapiens
gugcgccgcuagggguccaccug

SEQ ID NO: 2067 - RNA, 23 nt, Homo sapiens
ugcgccgcuagggguccaccugc

SEQ ID NO: 2068 - RNA, 23 nt, Homo sapiens
gcgccgcuagggguccaccugcc

SEQ ID NO: 2069 - RNA, 23 nt, Homo sapiens
cgccgcuagggguccaccugccu

SEQ ID NO: 2070 - RNA, 23 nt, Homo sapiens
gccgcuagggguccaccugccuu

SEQ ID NO: 2071 - RNA, 23 nt, Homo sapiens
ccgcuagggguccaccugccuuu

SEQ ID NO: 2072 - RNA, 23 nt, Homo sapiens
cgcuagggguccaccugccuuuu

SEQ ID NO: 2073 - RNA, 23 nt, Homo sapiens
gcuagggguccaccugccuuuug

SEQ ID NO: 2074 - RNA, 23 nt, Homo sapiens
cuagggguccaccugccuuuugu

SEQ ID NO: 2075 - RNA, 23 nt, Homo sapiens
uagggguccaccugccuuuugug

SEQ ID NO: 2076 - RNA, 23 nt, Homo sapiens
agggguccaccugccuuuugugg

SEQ ID NO: 2077 - RNA, 23 nt, Homo sapiens
gggguccaccugccuuuuguggg

SEQ ID NO: 2078 - RNA, 23 nt, Homo sapiens
ggguccaccugccuuuugugggc

SEQ ID NO: 2079 - RNA, 23 nt, Homo sapiens
gguccaccugccuuuugugggcu

SEQ ID NO: 2080 - RNA, 23 nt, Homo sapiens
guccaccugccuuuugugggcua

SEQ ID NO: 2081 - RNA, 23 nt, Homo sapiens
uccaccugccuuuugugggcuac

SEQ ID NO: 2082 - RNA, 23 nt, Homo sapiens
ccaccugccuuuugugggcuacu

SEQ ID NO: 2083 - RNA, 23 nt, Homo sapiens
caccugccuuuugugggcuacuc

SEQ ID NO: 2084 - RNA, 23 nt, Homo sapiens
accugccuuuugugggcuacucc

SEQ ID NO: 2085 - RNA, 23 nt, Homo sapiens
ccugccuuuugugggcuacuccu

SEQ ID NO: 2086 - RNA, 23 nt, Homo sapiens
cugccuuuugugggcuacuccua

SEQ ID NO: 2087 - RNA, 23 nt, Homo sapiens
ugccuuuugugggcuacuccuac

SEQ ID NO: 2088 - RNA, 23 nt, Homo sapiens
gccuuuugugggcuacuccuacu

SEQ ID NO: 2089 - RNA, 23 nt, Homo sapiens
ccuuuugugggcuacuccuacuc

SEQ ID NO: 2090 - RNA, 23 nt, Homo sapiens
cuuuugugggcuacuccuacucc

SEQ ID NO: 2091 - RNA, 23 nt, Homo sapiens
uuuugugggcuacuccuacuccu

SEQ ID NO: 2092 - RNA, 23 nt, Homo sapiens
uuugugggcuacuccuacuccug

SEQ ID NO: 2093 - RNA, 23 nt, Homo sapiens
uugugggcuacuccuacuccugc

SEQ ID NO: 2094 - RNA, 23 nt, Homo sapiens
ugugggcuacuccuacuccugca

SEQ ID NO: 2095 - RNA, 23 nt, Homo sapiens
gugggcuacuccuacuccugcau

SEQ ID NO: 2096 - RNA, 23 nt, Homo sapiens
ugggcuacuccuacuccugcaug

SEQ ID NO: 2097 - RNA, 23 nt, Homo sapiens
gggcuacuccuacuccugcaugg

SEQ ID NO: 2098 - RNA, 23 nt, Homo sapiens
ggcuacuccuacuccugcauggc

SEQ ID NO: 2099 - RNA, 23 nt, Homo sapiens
gcuacuccuacuccugcauggcc

SEQ ID NO: 2100 - RNA, 23 nt, Homo sapiens
cuacuccuacuccugcauggccc

SEQ ID NO: 2101 - RNA, 23 nt, Homo sapiens
uacuccuacuccugcauggcccu

SEQ ID NO: 2102 - RNA, 23 nt, Homo sapiens
acuccuacuccugcauggcccuc

SEQ ID NO: 2103 - RNA, 23 nt, Homo sapiens
cuccuacuccugcauggcccuca

SEQ ID NO: 2104 - RNA, 23 nt, Homo sapiens
uccuacuccugcauggcccucag

SEQ ID NO: 2105 - RNA, 23 nt, Homo sapiens
ccuacuccugcauggcccucagg

SEQ ID NO: 2106 - RNA, 23 nt, Homo sapiens
cuacuccugcauggcccucaggg

SEQ ID NO: 2107 - RNA, 23 nt, Homo sapiens
uacuccugcauggcccucaggga

SEQ ID NO: 2108 - RNA, 23 nt, Homo sapiens
acuccugcauggcccucagggac

SEQ ID NO: 2109 - RNA, 23 nt, Homo sapiens
cuccugcauggcccucagggaca

SEQ ID NO: 2110 - RNA, 23 nt, Homo sapiens
uccugcauggcccucagggacag

SEQ ID NO: 2111 - RNA, 23 nt, Homo sapiens
ccugcauggcccucagggacagu

SEQ ID NO: 2112 - RNA, 23 nt, Homo sapiens
cugcauggcccucagggacagug

SEQ ID NO: 2113 - RNA, 23 nt, Homo sapiens
ugcauggcccucagggacaguga

SEQ ID NO: 2114 - RNA, 23 nt, Homo sapiens
gcauggcccucagggacagugag

SEQ ID NO: 2115 - RNA, 23 nt, Homo sapiens
cauggcccucagggacagugagg

SEQ ID NO: 2116 - RNA, 23 nt, Homo sapiens
auggcccucagggacagugaggu

SEQ ID NO: 2117 - RNA, 23 nt, Homo sapiens
uggcccucagggacagugagguc

SEQ ID NO: 2118 - RNA, 23 nt, Homo sapiens
ggcccucagggacagugaggucc

SEQ ID NO: 2119 - RNA, 23 nt, Homo sapiens
gcccucagggacagugagguccc

SEQ ID NO: 2120 - RNA, 23 nt, Homo sapiens
cccucagggacagugagguccca

SEQ ID NO: 2121 - RNA, 23 nt, Homo sapiens
ccucagggacagugaggucccag

SEQ ID NO: 2122 - RNA, 23 nt, Homo sapiens
cucagggacagugaggucccagg

SEQ ID NO: 2123 - RNA, 23 nt, Homo sapiens
ucagggacagugaggucccaggc

SEQ ID NO: 2124 - RNA, 23 nt, Homo sapiens
cagggacagugaggucccaggcc

SEQ ID NO: 2125 - RNA, 23 nt, Homo sapiens
agggacagugaggucccaggccc

SEQ ID NO: 2126 - RNA, 23 nt, Homo sapiens
gggacagugaggucccaggcccc

SEQ ID NO: 2127 - RNA, 23 nt, Homo sapiens
ggacagugaggucccaggcccca

SEQ ID NO: 2128 - RNA, 23 nt, Homo sapiens
gacagugaggucccaggccccac

SEQ ID NO: 2129 - RNA, 23 nt, Homo sapiens
acagugaggucccaggccccaca

SEQ ID NO: 2130 - RNA, 23 nt, Homo sapiens
cagugaggucccaggccccacac

SEQ ID NO: 2131 - RNA, 23 nt, Homo sapiens
agugaggucccaggccccacacc

SEQ ID NO: 2132 - RNA, 23 nt, Homo sapiens
gugaggucccaggccccacaccc

SEQ ID NO: 2133 - RNA, 23 nt, Homo sapiens
ugaggucccaggccccacaccca

SEQ ID NO: 2134 - RNA, 23 nt, Homo sapiens
gaggucccaggccccacacccau

SEQ ID NO: 2135 - RNA, 23 nt, Homo sapiens
aggucccaggccccacacccaug

SEQ ID NO: 2136 - RNA, 23 nt, Homo sapiens
ggucccaggccccacacccaugg

SEQ ID NO: 2137 - RNA, 23 nt, Homo sapiens
gucccaggccccacacccaugga

SEQ ID NO: 2138 - RNA, 23 nt, Homo sapiens
ucccaggccccacacccauggaa

SEQ ID NO: 2139 - RNA, 23 nt, Homo sapiens
cccaggccccacacccauggaac

SEQ ID NO: 2140 - RNA, 23 nt, Homo sapiens
ccaggccccacacccauggaacu

SEQ ID NO: 2141 - RNA, 23 nt, Homo sapiens
caggccccacacccauggaacug

SEQ ID NO: 2142 - RNA, 23 nt, Homo sapiens
aggccccacacccauggaacugg

SEQ ID NO: 2143 - RNA, 23 nt, Homo sapiens
ggccccacacccauggaacugga

SEQ ID NO: 2144 - RNA, 23 nt, Homo sapiens
gccccacacccauggaacuggag

SEQ ID NO: 2145 - RNA, 23 nt, Homo sapiens
ccccacacccauggaacuggagg

SEQ ID NO: 2146 - RNA, 23 nt, Homo sapiens
cccacacccauggaacuggaggc

SEQ ID NO: 2147 - RNA, 23 nt, Homo sapiens
ccacacccauggaacuggaggcc

SEQ ID NO: 2148 - RNA, 23 nt, Homo sapiens
cacacccauggaacuggaggccg

SEQ ID NO: 2149 - RNA, 23 nt, Homo sapiens
acacccauggaacuggaggccga

SEQ ID NO: 2150 - RNA, 23 nt, Homo sapiens
cacccauggaacuggaggccgag

SEQ ID NO: 2151 - RNA, 23 nt, Homo sapiens
acccauggaacuggaggccgagc

SEQ ID NO: 2152 - RNA, 23 nt, Homo sapiens
cccauggaacuggaggccgagca

SEQ ID NO: 2153 - RNA, 23 nt, Homo sapiens
ccauggaacuggaggccgagcag

SEQ ID NO: 2154 - RNA, 23 nt, Homo sapiens
cauggaacuggaggccgagcagc

SEQ ID NO: 2155 - RNA, 23 nt, Homo sapiens
auggaacuggaggccgagcagcu

SEQ ID NO: 2156 - RNA, 23 nt, Homo sapiens
uggaacuggaggccgagcagcug

SEQ ID NO: 2157 - RNA, 23 nt, Homo sapiens
ggaacuggaggccgagcagcugc

SEQ ID NO: 2158 - RNA, 23 nt, Homo sapiens
gaacuggaggccgagcagcugcu

SEQ ID NO: 2159 - RNA, 23 nt, Homo sapiens
aacuggaggccgagcagcugcuu

SEQ ID NO: 2160 - RNA, 23 nt, Homo sapiens
acuggaggccgagcagcugcuug

SEQ ID NO: 2161 - RNA, 23 nt, Homo sapiens
cuggaggccgagcagcugcuuga

SEQ ID NO: 2162 - RNA, 23 nt, Homo sapiens
uggaggccgagcagcugcuugag

SEQ ID NO: 2163 - RNA, 23 nt, Homo sapiens
ggaggccgagcagcugcuugagc

SEQ ID NO: 2164 - RNA, 23 nt, Homo sapiens
gaggccgagcagcugcuugagcc

SEQ ID NO: 2165 - RNA, 23 nt, Homo sapiens
aggccgagcagcugcuugagcca

SEQ ID NO: 2166 - RNA, 23 nt, Homo sapiens
ggccgagcagcugcuugagccac

SEQ ID NO: 2167 - RNA, 23 nt, Homo sapiens
gccgagcagcugcuugagccaca

SEQ ID NO: 2168 - RNA, 23 nt, Homo sapiens
ccgagcagcugcuugagccacac

SEQ ID NO: 2169 - RNA, 23 nt, Homo sapiens
cgagcagcugcuugagccacacg

SEQ ID NO: 2170 - RNA, 23 nt, Homo sapiens
gagcagcugcuugagccacacgu

SEQ ID NO: 2171 - RNA, 23 nt, Homo sapiens
agcagcugcuugagccacacgug

SEQ ID NO: 2172 - RNA, 23 nt, Homo sapiens
gcagcugcuugagccacacgugc

SEQ ID NO: 2173 - RNA, 23 nt, Homo sapiens
cagcugcuugagccacacgugca

SEQ ID NO: 2174 - RNA, 23 nt, Homo sapiens
agcugcuugagccacacgugcaa

SEQ ID NO: 2175 - RNA, 23 nt, Homo sapiens
gcugcuugagccacacgugcaag

SEQ ID NO: 2176 - RNA, 23 nt, Homo sapiens
cugcuugagccacacgugcaagc

SEQ ID NO: 2177 - RNA, 23 nt, Homo sapiens
ugcuugagccacacgugcaagcg

SEQ ID NO: 2178 - RNA, 23 nt, Homo sapiens
gcuugagccacacgugcaagcgc

SEQ ID NO: 2179 - RNA, 23 nt, Homo sapiens
cuugagccacacgugcaagcgcc

SEQ ID NO: 2180 - RNA, 23 nt, Homo sapiens
uugagccacacgugcaagcgccc

SEQ ID NO: 2181 - RNA, 23 nt, Homo sapiens
ugagccacacgugcaagcgccca

SEQ ID NO: 2182 - RNA, 23 nt, Homo sapiens
gagccacacgugcaagcgcccag

SEQ ID NO: 2183 - RNA, 23 nt, Homo sapiens
agccacacgugcaagcgcccagc

SEQ ID NO: 2184 - RNA, 23 nt, Homo sapiens
gccacacgugcaagcgcccagcc

SEQ ID NO: 2185 - RNA, 23 nt, Homo sapiens
ccacacgugcaagcgcccagccu

SEQ ID NO: 2186 - RNA, 23 nt, Homo sapiens
cacacgugcaagcgcccagccug

SEQ ID NO: 2187 - RNA, 23 nt, Homo sapiens
acacgugcaagcgcccagccugg

SEQ ID NO: 2188 - RNA, 23 nt, Homo sapiens
cacgugcaagcgcccagccugga

SEQ ID NO: 2189 - RNA, 23 nt, Homo sapiens
acgugcaagcgcccagccuggag

SEQ ID NO: 2190 - RNA, 23 nt, Homo sapiens
cgugcaagcgcccagccuggagc

SEQ ID NO: 2191 - RNA, 23 nt, Homo sapiens
gugcaagcgcccagccuggagcc

SEQ ID NO: 2192 - RNA, 23 nt, Homo sapiens
ugcaagcgcccagccuggagccc

SEQ ID NO: 2193 - RNA, 23 nt, Homo sapiens
gcaagcgcccagccuggagcccu

SEQ ID NO: 2194 - RNA, 23 nt, Homo sapiens
caagcgcccagccuggagcccuc

SEQ ID NO: 2195 - RNA, 23 nt, Homo sapiens
aagcgcccagccuggagcccucg

SEQ ID NO: 2196 - RNA, 23 nt, Homo sapiens
agcgcccagccuggagcccucgg

SEQ ID NO: 2197 - RNA, 23 nt, Homo sapiens
gcgcccagccuggagcccucggu

SEQ ID NO: 2198 - RNA, 23 nt, Homo sapiens
cgcccagccuggagcccucggug

SEQ ID NO: 2199 - RNA, 23 nt, Homo sapiens
gcccagccuggagcccucggugu

SEQ ID NO: 2200 - RNA, 23 nt, Homo sapiens
cccagccuggagcccucgguguc

SEQ ID NO: 2201 - RNA, 23 nt, Homo sapiens
ccagccuggagcccucggugucc

SEQ ID NO: 2202 - RNA, 23 nt, Homo sapiens
cagccuggagcccucgguguccc

SEQ ID NO: 2203 - RNA, 23 nt, Homo sapiens
agccuggagcccucggugucccc

SEQ ID NO: 2204 - RNA, 23 nt, Homo sapiens
gccuggagcccucggugucccca

SEQ ID NO: 2205 - RNA, 23 nt, Homo sapiens
ccuggagcccucgguguccccac

SEQ ID NO: 2206 - RNA, 23 nt, Homo sapiens
cuggagcccucgguguccccaca

SEQ ID NO: 2207 - RNA, 23 nt, Homo sapiens
uggagcccucgguguccccacag

SEQ ID NO: 2208 - RNA, 23 nt, Homo sapiens
ggagcccucgguguccccacagg

SEQ ID NO: 2209 - RNA, 23 nt, Homo sapiens
gagcccucgguguccccacagga

SEQ ID NO: 2210 - RNA, 23 nt, Homo sapiens
agcccucgguguccccacaggau

SEQ ID NO: 2211 - RNA, 23 nt, Homo sapiens
gcccucgguguccccacaggaug

SEQ ID NO: 2212 - RNA, 23 nt, Homo sapiens
cccucgguguccccacaggauga

SEQ ID NO: 2213 - RNA, 23 nt, Homo sapiens
ccucgguguccccacaggaugaa

SEQ ID NO: 2214 - RNA, 23 nt, Homo sapiens
cucgguguccccacaggaugaaa

SEQ ID NO: 2215 - RNA, 23 nt, Homo sapiens
ucgguguccccacaggaugaaac

SEQ ID NO: 2216 - RNA, 23 nt, Homo sapiens
cgguguccccacaggaugaaaca

SEQ ID NO: 2217 - RNA, 23 nt, Homo sapiens
gguguccccacaggaugaaacag

SEQ ID NO: 2218 - RNA, 23 nt, Homo sapiens
guguccccacaggaugaaacagc

SEQ ID NO: 2219 - RNA, 23 nt, Homo sapiens
uguccccacaggaugaaacagcu

SEQ ID NO: 2220 - RNA, 23 nt, Homo sapiens
guccccacaggaugaaacagcug

SEQ ID NO: 2221 - RNA, 23 nt, Homo sapiens
uccccacaggaugaaacagcuga

SEQ ID NO: 2222 - RNA, 23 nt, Homo sapiens
ccccacaggaugaaacagcugaa

SEQ ID NO: 2223 - RNA, 23 nt, Homo sapiens
cccacaggaugaaacagcugaag

SEQ ID NO: 2224 - RNA, 23 nt, Homo sapiens
ccacaggaugaaacagcugaagu

SEQ ID NO: 2225 - RNA, 23 nt, Homo sapiens
cacaggaugaaacagcugaagug

SEQ ID NO: 2226 - RNA, 23 nt, Homo sapiens
acaggaugaaacagcugaagugg

SEQ ID NO: 2227 - RNA, 23 nt, Homo sapiens
caggaugaaacagcugaaguggc

SEQ ID NO: 2228 - RNA, 23 nt, Homo sapiens
aggaugaaacagcugaaguggca

SEQ ID NO: 2229 - RNA, 23 nt, Homo sapiens
ggaugaaacagcugaaguggcag

SEQ ID NO: 2230 - RNA, 23 nt, Homo sapiens
gaugaaacagcugaaguggcagu

SEQ ID NO: 2231 - RNA, 23 nt, Homo sapiens
augaaacagcugaaguggcaguu

SEQ ID NO: 2232 - RNA, 23 nt, Homo sapiens
ugaaacagcugaaguggcaguuc

SEQ ID NO: 2233 - RNA, 23 nt, Homo sapiens
gaaacagcugaaguggcaguucc

SEQ ID NO: 2234 - RNA, 23 nt, Homo sapiens
aaacagcugaaguggcaguucca

SEQ ID NO: 2235 - RNA, 23 nt, Homo sapiens
aacagcugaaguggcaguuccag

SEQ ID NO: 2236 - RNA, 23 nt, Homo sapiens
acagcugaaguggcaguuccagc

SEQ ID NO: 2237 - RNA, 23 nt, Homo sapiens
cagcugaaguggcaguuccagcg

SEQ ID NO: 2238 - RNA, 23 nt, Homo sapiens
agcugaaguggcaguuccagcgg

SEQ ID NO: 2239 - RNA, 23 nt, Homo sapiens
gcugaaguggcaguuccagcggc

SEQ ID NO: 2240 - RNA, 23 nt, Homo sapiens
cugaaguggcaguuccagcggcu

SEQ ID NO: 2241 - RNA, 23 nt, Homo sapiens
ugaaguggcaguuccagcggcug

SEQ ID NO: 2242 - RNA, 23 nt, Homo sapiens
gaaguggcaguuccagcggcugu

SEQ ID NO: 2243 - RNA, 23 nt, Homo sapiens
aaguggcaguuccagcggcuguc

SEQ ID NO: 2244 - RNA, 23 nt, Homo sapiens
aguggcaguuccagcggcugucc

SEQ ID NO: 2245 - RNA, 23 nt, Homo sapiens
guggcaguuccagcggcuguccc

SEQ ID NO: 2246 - RNA, 23 nt, Homo sapiens
uggcaguuccagcggcugucccu

SEQ ID NO: 2247 - RNA, 23 nt, Homo sapiens
ggcaguuccagcggcugucccug

SEQ ID NO: 2248 - RNA, 23 nt, Homo sapiens
gcaguuccagcggcugucccugc

SEQ ID NO: 2249 - RNA, 23 nt, Homo sapiens
caguuccagcggcugucccugcg

SEQ ID NO: 2250 - RNA, 23 nt, Homo sapiens
aguuccagcggcugucccugcgg

SEQ ID NO: 2251 - RNA, 23 nt, Homo sapiens
guuccagcggcugucccugcggc

SEQ ID NO: 2252 - RNA, 23 nt, Homo sapiens
uuccagcggcugucccugcggca

SEQ ID NO: 2253 - RNA, 23 nt, Homo sapiens
uccagcggcugucccugcggcag

SEQ ID NO: 2254 - RNA, 23 nt, Homo sapiens
ccagcggcugucccugcggcaga

SEQ ID NO: 2255 - RNA, 23 nt, Homo sapiens
cagcggcugucccugcggcagag

SEQ ID NO: 2256 - RNA, 23 nt, Homo sapiens
agcggcugucccugcggcagagg

SEQ ID NO: 2257 - RNA, 23 nt, Homo sapiens
gcggcugucccugcggcagaggc

SEQ ID NO: 2258 - RNA, 23 nt, Homo sapiens
cggcugucccugcggcagaggcu

SEQ ID NO: 2259 - RNA, 23 nt, Homo sapiens
ggcugucccugcggcagaggcug

SEQ ID NO: 2260 - RNA, 23 nt, Homo sapiens
gcugucccugcggcagaggcuga

SEQ ID NO: 2261 - RNA, 23 nt, Homo sapiens
cugucccugcggcagaggcugag

SEQ ID NO: 2262 - RNA, 23 nt, Homo sapiens
ugucccugcggcagaggcugagg

SEQ ID NO: 2263 - RNA, 23 nt, Homo sapiens
gucccugcggcagaggcugaggc

SEQ ID NO: 2264 - RNA, 23 nt, Homo sapiens
ucccugcggcagaggcugaggcc

SEQ ID NO: 2265 - RNA, 23 nt, Homo sapiens
cccugcggcagaggcugaggccg

SEQ ID NO: 2266 - RNA, 23 nt, Homo sapiens
ccugcggcagaggcugaggccga

SEQ ID NO: 2267 - RNA, 23 nt, Homo sapiens
cugcggcagaggcugaggccgag

SEQ ID NO: 2268 - RNA, 23 nt, Homo sapiens
ugcggcagaggcugaggccgagg

SEQ ID NO: 2269 - RNA, 23 nt, Homo sapiens
gcggcagaggcugaggccgaggu

SEQ ID NO: 2270 - RNA, 23 nt, Homo sapiens
cggcagaggcugaggccgaggug

SEQ ID NO: 2271 - RNA, 23 nt, Homo sapiens
ggcagaggcugaggccgagguga

SEQ ID NO: 2272 - RNA, 23 nt, Homo sapiens
gcagaggcugaggccgaggugac

SEQ ID NO: 2273 - RNA, 23 nt, Homo sapiens
cagaggcugaggccgaggugacg

SEQ ID NO: 2274 - RNA, 23 nt, Homo sapiens
agaggcugaggccgaggugacgc

SEQ ID NO: 2275 - RNA, 23 nt, Homo sapiens
gaggcugaggccgaggugacgcu

SEQ ID NO: 2276 - RNA, 23 nt, Homo sapiens
aggcugaggccgaggugacgcug

SEQ ID NO: 2277 - RNA, 23 nt, Homo sapiens
ggcugaggccgaggugacgcugc

SEQ ID NO: 2278 - RNA, 23 nt, Homo sapiens
gcugaggccgaggugacgcugcg

SEQ ID NO: 2279 - RNA, 23 nt, Homo sapiens
cugaggccgaggugacgcugcgg

SEQ ID NO: 2280 - RNA, 23 nt, Homo sapiens
ugaggccgaggugacgcugcggg

SEQ ID NO: 2281 - RNA, 23 nt, Homo sapiens
gaggccgaggugacgcugcggga

SEQ ID NO: 2282 - RNA, 23 nt, Homo sapiens
aggccgaggugacgcugcgggag

SEQ ID NO: 2283 - RNA, 23 nt, Homo sapiens
ggccgaggugacgcugcgggagc

SEQ ID NO: 2284 - RNA, 23 nt, Homo sapiens
gccgaggugacgcugcgggagcu

SEQ ID NO: 2285 - RNA, 23 nt, Homo sapiens
ccgaggugacgcugcgggagcuc

SEQ ID NO: 2286 - RNA, 23 nt, Homo sapiens
cgaggugacgcugcgggagcucc

SEQ ID NO: 2287 - RNA, 23 nt, Homo sapiens
gaggugacgcugcgggagcucca

SEQ ID NO: 2288 - RNA, 23 nt, Homo sapiens
aggugacgcugcgggagcuccag

SEQ ID NO: 2289 - RNA, 23 nt, Homo sapiens
ggugacgcugcgggagcuccagg

SEQ ID NO: 2290 - RNA, 23 nt, Homo sapiens
gugacgcugcgggagcuccagga

SEQ ID NO: 2291 - RNA, 23 nt, Homo sapiens
ugacgcugcgggagcuccaggaa

SEQ ID NO: 2292 - RNA, 23 nt, Homo sapiens
gacgcugcgggagcuccaggaag

SEQ ID NO: 2293 - RNA, 23 nt, Homo sapiens
acgcugcgggagcuccaggaagc

SEQ ID NO: 2294 - RNA, 23 nt, Homo sapiens
cgcugcgggagcuccaggaagcc

SEQ ID NO: 2295 - RNA, 23 nt, Homo sapiens
gcugcgggagcuccaggaagccc

SEQ ID NO: 2296 - RNA, 23 nt, Homo sapiens
cugcgggagcuccaggaagcccu

SEQ ID NO: 2297 - RNA, 23 nt, Homo sapiens
ugcgggagcuccaggaagcccug

SEQ ID NO: 2298 - RNA, 23 nt, Homo sapiens
gcgggagcuccaggaagcccugg

SEQ ID NO: 2299 - RNA, 23 nt, Homo sapiens
cgggagcuccaggaagcccugga

SEQ ID NO: 2300 - RNA, 23 nt, Homo sapiens
gggagcuccaggaagcccuggag

SEQ ID NO: 2301 - RNA, 23 nt, Homo sapiens
ggagcuccaggaagcccuggagg

SEQ ID NO: 2302 - RNA, 23 nt, Homo sapiens
gagcuccaggaagcccuggagga

SEQ ID NO: 2303 - RNA, 23 nt, Homo sapiens
agcuccaggaagcccuggaggag

SEQ ID NO: 2304 - RNA, 23 nt, Homo sapiens
gcuccaggaagcccuggaggagg

SEQ ID NO: 2305 - RNA, 23 nt, Homo sapiens
cuccaggaagcccuggaggagga

SEQ ID NO: 2306 - RNA, 23 nt, Homo sapiens
uccaggaagcccuggaggaggag

SEQ ID NO: 2307 - RNA, 23 nt, Homo sapiens
ccaggaagcccuggaggaggagg

SEQ ID NO: 2308 - RNA, 23 nt, Homo sapiens
caggaagcccuggaggaggaggu

SEQ ID NO: 2309 - RNA, 23 nt, Homo sapiens
aggaagcccuggaggaggaggug

SEQ ID NO: 2310 - RNA, 23 nt, Homo sapiens
ggaagcccuggaggaggaggugc

SEQ ID NO: 2311 - RNA, 23 nt, Homo sapiens
gaagcccuggaggaggaggugcu

SEQ ID NO: 2312 - RNA, 23 nt, Homo sapiens
aagcccuggaggaggaggugcuc

SEQ ID NO: 2313 - RNA, 23 nt, Homo sapiens
agcccuggaggaggaggugcuca

SEQ ID NO: 2314 - RNA, 23 nt, Homo sapiens
gcccuggaggaggaggugcucac

SEQ ID NO: 2315 - RNA, 23 nt, Homo sapiens
cccuggaggaggaggugcucacc

SEQ ID NO: 2316 - RNA, 23 nt, Homo sapiens
ccuggaggaggaggugcucaccc

SEQ ID NO: 2317 - RNA, 23 nt, Homo sapiens
cuggaggaggaggugcucacccg

SEQ ID NO: 2318 - RNA, 23 nt, Homo sapiens
uggaggaggaggugcucacccgg

SEQ ID NO: 2319 - RNA, 23 nt, Homo sapiens
ggaggaggaggugcucacccggc

SEQ ID NO: 2320 - RNA, 23 nt, Homo sapiens
gaggaggaggugcucacccggca

SEQ ID NO: 2321 - RNA, 23 nt, Homo sapiens
aggaggaggugcucacccggcag

SEQ ID NO: 2322 - RNA, 23 nt, Homo sapiens
ggaggaggugcucacccggcaga

SEQ ID NO: 2323 - RNA, 23 nt, Homo sapiens
gaggaggugcucacccggcagag

SEQ ID NO: 2324 - RNA, 23 nt, Homo sapiens
aggaggugcucacccggcagagc

SEQ ID NO: 2325 - RNA, 23 nt, Homo sapiens
ggaggugcucacccggcagagcc

SEQ ID NO: 2326 - RNA, 23 nt, Homo sapiens
gaggugcucacccggcagagccu

SEQ ID NO: 2327 - RNA, 23 nt, Homo sapiens
aggugcucacccggcagagccug

SEQ ID NO: 2328 - RNA, 23 nt, Homo sapiens
ggugcucacccggcagagccuga

SEQ ID NO: 2329 - RNA, 23 nt, Homo sapiens
gugcucacccggcagagccugag

SEQ ID NO: 2330 - RNA, 23 nt, Homo sapiens
ugcucacccggcagagccugagc

SEQ ID NO: 2331 - RNA, 23 nt, Homo sapiens
gcucacccggcagagccugagcc

SEQ ID NO: 2332 - RNA, 23 nt, Homo sapiens
cucacccggcagagccugagccg

SEQ ID NO: 2333 - RNA, 23 nt, Homo sapiens
ucacccggcagagccugagccgg

SEQ ID NO: 2334 - RNA, 23 nt, Homo sapiens
cacccggcagagccugagccggg

SEQ ID NO: 2335 - RNA, 23 nt, Homo sapiens
acccggcagagccugagccggga

SEQ ID NO: 2336 - RNA, 23 nt, Homo sapiens
cccggcagagccugagccgggag

SEQ ID NO: 2337 - RNA, 23 nt, Homo sapiens
ccggcagagccugagccgggaga

SEQ ID NO: 2338 - RNA, 23 nt, Homo sapiens
cggcagagccugagccgggagau

SEQ ID NO: 2339 - RNA, 23 nt, Homo sapiens
ggcagagccugagccgggagaug

SEQ ID NO: 2340 - RNA, 23 nt, Homo sapiens
gcagagccugagccgggagaugg

SEQ ID NO: 2341 - RNA, 23 nt, Homo sapiens
cagagccugagccgggagaugga

SEQ ID NO: 2342 - RNA, 23 nt, Homo sapiens
agagccugagccgggagauggag

SEQ ID NO: 2343 - RNA, 23 nt, Homo sapiens
gagccugagccgggagauggagg

SEQ ID NO: 2344 - RNA, 23 nt, Homo sapiens
agccugagccgggagauggaggc

SEQ ID NO: 2345 - RNA, 23 nt, Homo sapiens
gccugagccgggagauggaggcc

SEQ ID NO: 2346 - RNA, 23 nt, Homo sapiens
ccugagccgggagauggaggcca

SEQ ID NO: 2347 - RNA, 23 nt, Homo sapiens
cugagccgggagauggaggccau

SEQ ID NO: 2348 - RNA, 23 nt, Homo sapiens
ugagccgggagauggaggccauc

SEQ ID NO: 2349 - RNA, 23 nt, Homo sapiens
gagccgggagauggaggccaucc

SEQ ID NO: 2350 - RNA, 23 nt, Homo sapiens
agccgggagauggaggccauccg

SEQ ID NO: 2351 - RNA, 23 nt, Homo sapiens
gccgggagauggaggccauccgc

SEQ ID NO: 2352 - RNA, 23 nt, Homo sapiens
ccgggagauggaggccauccgca

SEQ ID NO: 2353 - RNA, 23 nt, Homo sapiens
cgggagauggaggccauccgcac

SEQ ID NO: 2354 - RNA, 23 nt, Homo sapiens
gggagauggaggccauccgcacg

SEQ ID NO: 2355 - RNA, 23 nt, Homo sapiens
ggagauggaggccauccgcacgg

SEQ ID NO: 2356 - RNA, 23 nt, Homo sapiens
gagauggaggccauccgcacgga

SEQ ID NO: 2357 - RNA, 23 nt, Homo sapiens
agauggaggccauccgcacggac

SEQ ID NO: 2358 - RNA, 23 nt, Homo sapiens
gauggaggccauccgcacggaca

SEQ ID NO: 2359 - RNA, 23 nt, Homo sapiens
auggaggccauccgcacggacaa

SEQ ID NO: 2360 - RNA, 23 nt, Homo sapiens
uggaggccauccgcacggacaac

SEQ ID NO: 2361 - RNA, 23 nt, Homo sapiens
ggaggccauccgcacggacaacc

SEQ ID NO: 2362 - RNA, 23 nt, Homo sapiens
gaggccauccgcacggacaacca

SEQ ID NO: 2363 - RNA, 23 nt, Homo sapiens
aggccauccgcacggacaaccag

SEQ ID NO: 2364 - RNA, 23 nt, Homo sapiens
ggccauccgcacggacaaccaga

SEQ ID NO: 2365 - RNA, 23 nt, Homo sapiens
gccauccgcacggacaaccagaa

SEQ ID NO: 2366 - RNA, 23 nt, Homo sapiens
ccauccgcacggacaaccagaac

SEQ ID NO: 2367 - RNA, 23 nt, Homo sapiens
cauccgcacggacaaccagaacu

SEQ ID NO: 2368 - RNA, 23 nt, Homo sapiens
auccgcacggacaaccagaacuu

SEQ ID NO: 2369 - RNA, 23 nt, Homo sapiens
uccgcacggacaaccagaacuuc

SEQ ID NO: 2370 - RNA, 23 nt, Homo sapiens
ccgcacggacaaccagaacuucg

SEQ ID NO: 2371 - RNA, 23 nt, Homo sapiens
cgcacggacaaccagaacuucgc

SEQ ID NO: 2372 - RNA, 23 nt, Homo sapiens
gcacggacaaccagaacuucgcc

SEQ ID NO: 2373 - RNA, 23 nt, Homo sapiens
cacggacaaccagaacuucgcca

SEQ ID NO: 2374 - RNA, 23 nt, Homo sapiens
acggacaaccagaacuucgccag

SEQ ID NO: 2375 - RNA, 23 nt, Homo sapiens
cggacaaccagaacuucgccagu

SEQ ID NO: 2376 - RNA, 23 nt, Homo sapiens
ggacaaccagaacuucgccaguc

SEQ ID NO: 2377 - RNA, 23 nt, Homo sapiens
gacaaccagaacuucgccaguca

SEQ ID NO: 2378 - RNA, 23 nt, Homo sapiens
acaaccagaacuucgccagucaa

SEQ ID NO: 2379 - RNA, 23 nt, Homo sapiens
caaccagaacuucgccagucaac

SEQ ID NO: 2380 - RNA, 23 nt, Homo sapiens
aaccagaacuucgccagucaacu

SEQ ID NO: 2381 - RNA, 23 nt, Homo sapiens
accagaacuucgccagucaacua

SEQ ID NO: 2382 - RNA, 23 nt, Homo sapiens
ccagaacuucgccagucaacuac

SEQ ID NO: 2383 - RNA, 23 nt, Homo sapiens
cagaacuucgccagucaacuacg

SEQ ID NO: 2384 - RNA, 23 nt, Homo sapiens
agaacuucgccagucaacuacgc

SEQ ID NO: 2385 - RNA, 23 nt, Homo sapiens
gaacuucgccagucaacuacgcg

SEQ ID NO: 2386 - RNA, 23 nt, Homo sapiens
aacuucgccagucaacuacgcga

SEQ ID NO: 2387 - RNA, 23 nt, Homo sapiens
acuucgccagucaacuacgcgag

SEQ ID NO: 2388 - RNA, 23 nt, Homo sapiens
cuucgccagucaacuacgcgagg

SEQ ID NO: 2389 - RNA, 23 nt, Homo sapiens
uucgccagucaacuacgcgaggc

SEQ ID NO: 2390 - RNA, 23 nt, Homo sapiens
ucgccagucaacuacgcgaggca

SEQ ID NO: 2391 - RNA, 23 nt, Homo sapiens
cgccagucaacuacgcgaggcag

SEQ ID NO: 2392 - RNA, 23 nt, Homo sapiens
gccagucaacuacgcgaggcaga

SEQ ID NO: 2393 - RNA, 23 nt, Homo sapiens
ccagucaacuacgcgaggcagag

SEQ ID NO: 2394 - RNA, 23 nt, Homo sapiens
cagucaacuacgcgaggcagagg

SEQ ID NO: 2395 - RNA, 23 nt, Homo sapiens
agucaacuacgcgaggcagaggc

SEQ ID NO: 2396 - RNA, 23 nt, Homo sapiens
gucaacuacgcgaggcagaggcu

SEQ ID NO: 2397 - RNA, 23 nt, Homo sapiens
ucaacuacgcgaggcagaggcuc

SEQ ID NO: 2398 - RNA, 23 nt, Homo sapiens
caacuacgcgaggcagaggcucg

SEQ ID NO: 2399 - RNA, 23 nt, Homo sapiens
aacuacgcgaggcagaggcucgg

SEQ ID NO: 2400 - RNA, 23 nt, Homo sapiens
acuacgcgaggcagaggcucgga

SEQ ID NO: 2401 - RNA, 23 nt, Homo sapiens
cuacgcgaggcagaggcucggaa

SEQ ID NO: 2402 - RNA, 23 nt, Homo sapiens
uacgcgaggcagaggcucggaac

SEQ ID NO: 2403 - RNA, 23 nt, Homo sapiens
acgcgaggcagaggcucggaacc

SEQ ID NO: 2404 - RNA, 23 nt, Homo sapiens
cgcgaggcagaggcucggaaccg

SEQ ID NO: 2405 - RNA, 23 nt, Homo sapiens
gcgaggcagaggcucggaaccgg

SEQ ID NO: 2406 - RNA, 23 nt, Homo sapiens
cgaggcagaggcucggaaccggg

SEQ ID NO: 2407 - RNA, 23 nt, Homo sapiens
gaggcagaggcucggaaccggga

SEQ ID NO: 2408 - RNA, 23 nt, Homo sapiens
aggcagaggcucggaaccgggac

SEQ ID NO: 2409 - RNA, 23 nt, Homo sapiens
ggcagaggcucggaaccgggacc

SEQ ID NO: 2410 - RNA, 23 nt, Homo sapiens
gcagaggcucggaaccgggaccu

SEQ ID NO: 2411 - RNA, 23 nt, Homo sapiens
cagaggcucggaaccgggaccua

SEQ ID NO: 2412 - RNA, 23 nt, Homo sapiens
agaggcucggaaccgggaccuag

SEQ ID NO: 2413 - RNA, 23 nt, Homo sapiens
gaggcucggaaccgggaccuaga

SEQ ID NO: 2414 - RNA, 23 nt, Homo sapiens
aggcucggaaccgggaccuagag

SEQ ID NO: 2415 - RNA, 23 nt, Homo sapiens
ggcucggaaccgggaccuagagg

SEQ ID NO: 2416 - RNA, 23 nt, Homo sapiens
gcucggaaccgggaccuagaggc

SEQ ID NO: 2417 - RNA, 23 nt, Homo sapiens
cucggaaccgggaccuagaggca

SEQ ID NO: 2418 - RNA, 23 nt, Homo sapiens
ucggaaccgggaccuagaggcac

SEQ ID NO: 2419 - RNA, 23 nt, Homo sapiens
cggaaccgggaccuagaggcaca

SEQ ID NO: 2420 - RNA, 23 nt, Homo sapiens
ggaaccgggaccuagaggcacac

SEQ ID NO: 2421 - RNA, 23 nt, Homo sapiens
gaaccgggaccuagaggcacacg

SEQ ID NO: 2422 - RNA, 23 nt, Homo sapiens
aaccgggaccuagaggcacacgu

SEQ ID NO: 2423 - RNA, 23 nt, Homo sapiens
accgggaccuagaggcacacguc

SEQ ID NO: 2424 - RNA, 23 nt, Homo sapiens
ccgggaccuagaggcacacgucc

SEQ ID NO: 2425 - RNA, 23 nt, Homo sapiens
cgggaccuagaggcacacguccg

SEQ ID NO: 2426 - RNA, 23 nt, Homo sapiens
gggaccuagaggcacacguccgg

SEQ ID NO: 2427 - RNA, 23 nt, Homo sapiens
ggaccuagaggcacacguccggc

SEQ ID NO: 2428 - RNA, 23 nt, Homo sapiens
gaccuagaggcacacguccggca

SEQ ID NO: 2429 - RNA, 23 nt, Homo sapiens
accuagaggcacacguccggcag

SEQ ID NO: 2430 - RNA, 23 nt, Homo sapiens
ccuagaggcacacguccggcagu

SEQ ID NO: 2431 - RNA, 23 nt, Homo sapiens
cuagaggcacacguccggcaguu

SEQ ID NO: 2432 - RNA, 23 nt, Homo sapiens
uagaggcacacguccggcaguug

SEQ ID NO: 2433 - RNA, 23 nt, Homo sapiens
agaggcacacguccggcaguugc

SEQ ID NO: 2434 - RNA, 23 nt, Homo sapiens
gaggcacacguccggcaguugca

SEQ ID NO: 2435 - RNA, 23 nt, Homo sapiens
aggcacacguccggcaguugcag

SEQ ID NO: 2436 - RNA, 23 nt, Homo sapiens
ggcacacguccggcaguugcagg

SEQ ID NO: 2437 - RNA, 23 nt, Homo sapiens
gcacacguccggcaguugcagga

SEQ ID NO: 2438 - RNA, 23 nt, Homo sapiens
cacacguccggcaguugcaggag

SEQ ID NO: 2439 - RNA, 23 nt, Homo sapiens
acacguccggcaguugcaggagc

SEQ ID NO: 2440 - RNA, 23 nt, Homo sapiens
cacguccggcaguugcaggagcg

SEQ ID NO: 2441 - RNA, 23 nt, Homo sapiens
acguccggcaguugcaggagcgg

SEQ ID NO: 2442 - RNA, 23 nt, Homo sapiens
cguccggcaguugcaggagcgga

SEQ ID NO: 2443 - RNA, 23 nt, Homo sapiens
guccggcaguugcaggagcggau

SEQ ID NO: 2444 - RNA, 23 nt, Homo sapiens
uccggcaguugcaggagcggaug

SEQ ID NO: 2445 - RNA, 23 nt, Homo sapiens
ccggcaguugcaggagcggaugg

SEQ ID NO: 2446 - RNA, 23 nt, Homo sapiens
cggcaguugcaggagcggaugga

SEQ ID NO: 2447 - RNA, 23 nt, Homo sapiens
ggcaguugcaggagcggauggag

SEQ ID NO: 2448 - RNA, 23 nt, Homo sapiens
gcaguugcaggagcggauggagu

SEQ ID NO: 2449 - RNA, 23 nt, Homo sapiens
caguugcaggagcggauggaguu

SEQ ID NO: 2450 - RNA, 23 nt, Homo sapiens
aguugcaggagcggauggaguug

SEQ ID NO: 2451 - RNA, 23 nt, Homo sapiens
guugcaggagcggauggaguugc

SEQ ID NO: 2452 - RNA, 23 nt, Homo sapiens
uugcaggagcggauggaguugcu

SEQ ID NO: 2453 - RNA, 23 nt, Homo sapiens
ugcaggagcggauggaguugcug

SEQ ID NO: 2454 - RNA, 23 nt, Homo sapiens
gcaggagcggauggaguugcugc

SEQ ID NO: 2455 - RNA, 23 nt, Homo sapiens
caggagcggauggaguugcugca

SEQ ID NO: 2456 - RNA, 23 nt, Homo sapiens
aggagcggauggaguugcugcag

SEQ ID NO: 2457 - RNA, 23 nt, Homo sapiens
ggagcggauggaguugcugcagg

SEQ ID NO: 2458 - RNA, 23 nt, Homo sapiens
gagcggauggaguugcugcaggc

SEQ ID NO: 2459 - RNA, 23 nt, Homo sapiens
agcggauggaguugcugcaggca

SEQ ID NO: 2460 - RNA, 23 nt, Homo sapiens
gcggauggaguugcugcaggcag

SEQ ID NO: 2461 - RNA, 23 nt, Homo sapiens
cggauggaguugcugcaggcaga

SEQ ID NO: 2462 - RNA, 23 nt, Homo sapiens
ggauggaguugcugcaggcagag

SEQ ID NO: 2463 - RNA, 23 nt, Homo sapiens
gauggaguugcugcaggcagagg

SEQ ID NO: 2464 - RNA, 23 nt, Homo sapiens
auggaguugcugcaggcagaggg

SEQ ID NO: 2465 - RNA, 23 nt, Homo sapiens
uggaguugcugcaggcagaggga

SEQ ID NO: 2466 - RNA, 23 nt, Homo sapiens
ggaguugcugcaggcagagggag

SEQ ID NO: 2467 - RNA, 23 nt, Homo sapiens
gaguugcugcaggcagagggagc

SEQ ID NO: 2468 - RNA, 23 nt, Homo sapiens
aguugcugcaggcagagggagcc

SEQ ID NO: 2469 - RNA, 23 nt, Homo sapiens
guugcugcaggcagagggagcca

SEQ ID NO: 2470 - RNA, 23 nt, Homo sapiens
uugcugcaggcagagggagccac

SEQ ID NO: 2471 - RNA, 23 nt, Homo sapiens
ugcugcaggcagagggagccaca

SEQ ID NO: 2472 - RNA, 23 nt, Homo sapiens
gcugcaggcagagggagccacag

SEQ ID NO: 2473 - RNA, 23 nt, Homo sapiens
cugcaggcagagggagccacagg

SEQ ID NO: 2474 - RNA, 23 nt, Homo sapiens
ugcaggcagagggagccacaggu

SEQ ID NO: 2475 - RNA, 23 nt, Homo sapiens
gcaggcagagggagccacagguc

SEQ ID NO: 2476 - RNA, 23 nt, Homo sapiens
caggcagagggagccacaggucc

SEQ ID NO: 2477 - RNA, 23 nt, Homo sapiens
aggcagagggagccacagguccc

SEQ ID NO: 2478 - RNA, 23 nt, Homo sapiens
ggcagagggagccacaggucccu

SEQ ID NO: 2479 - RNA, 23 nt, Homo sapiens
gcagagggagccacaggucccua

SEQ ID NO: 2480 - RNA, 23 nt, Homo sapiens
cagagggagccacaggucccuag

SEQ ID NO: 2481 - RNA, 23 nt, Homo sapiens
agagggagccacaggucccuagg

SEQ ID NO: 2482 - RNA, 23 nt, Homo sapiens
gagggagccacaggucccuaggc

SEQ ID NO: 2483 - RNA, 23 nt, Homo sapiens
agggagccacaggucccuaggcc

SEQ ID NO: 2484 - RNA, 23 nt, Homo sapiens
gggagccacaggucccuaggccu

SEQ ID NO: 2485 - RNA, 23 nt, Homo sapiens
ggagccacaggucccuaggccug

SEQ ID NO: 2486 - RNA, 23 nt, Homo sapiens
gagccacaggucccuaggccugg

SEQ ID NO: 2487 - RNA, 23 nt, Homo sapiens
agccacaggucccuaggccuggc

SEQ ID NO: 2488 - RNA, 23 nt, Homo sapiens
gccacaggucccuaggccuggcc

SEQ ID NO: 2489 - RNA, 23 nt, Homo sapiens
ccacaggucccuaggccuggccu

SEQ ID NO: 2490 - RNA, 23 nt, Homo sapiens
cacaggucccuaggccuggccua

SEQ ID NO: 2491 - RNA, 23 nt, Homo sapiens
acaggucccuaggccuggccuau

SEQ ID NO: 2492 - RNA, 23 nt, Homo sapiens
caggucccuaggccuggccuauc

SEQ ID NO: 2493 - RNA, 23 nt, Homo sapiens
aggucccuaggccuggccuaucg

SEQ ID NO: 2494 - RNA, 23 nt, Homo sapiens
ggucccuaggccuggccuaucgg

SEQ ID NO: 2495 - RNA, 23 nt, Homo sapiens
gucccuaggccuggccuaucgga

SEQ ID NO: 2496 - RNA, 23 nt, Homo sapiens
ucccuaggccuggccuaucggag

SEQ ID NO: 2497 - RNA, 23 nt, Homo sapiens
cccuaggccuggccuaucggagg

SEQ ID NO: 2498 - RNA, 23 nt, Homo sapiens
ccuaggccuggccuaucggaggc

SEQ ID NO: 2499 - RNA, 23 nt, Homo sapiens
cuaggccuggccuaucggaggcg

SEQ ID NO: 2500 - RNA, 23 nt, Homo sapiens
uaggccuggccuaucggaggcgc

SEQ ID NO: 2501 - RNA, 23 nt, Homo sapiens
aggccuggccuaucggaggcgcu

SEQ ID NO: 2502 - RNA, 23 nt, Homo sapiens
ggccuggccuaucggaggcgcuu

SEQ ID NO: 2503 - RNA, 23 nt, Homo sapiens
gccuggccuaucggaggcgcuuu

SEQ ID NO: 2504 - RNA, 23 nt, Homo sapiens
ccuggccuaucggaggcgcuuuc

SEQ ID NO: 2505 - RNA, 23 nt, Homo sapiens
cuggccuaucggaggcgcuuucc

SEQ ID NO: 2506 - RNA, 23 nt, Homo sapiens
uggccuaucggaggcgcuuuccc

SEQ ID NO: 2507 - RNA, 23 nt, Homo sapiens
ggccuaucggaggcgcuuucccu

SEQ ID NO: 2508 - RNA, 23 nt, Homo sapiens
gccuaucggaggcgcuuucccug

SEQ ID NO: 2509 - RNA, 23 nt, Homo sapiens
ccuaucggaggcgcuuucccugc

SEQ ID NO: 2510 - RNA, 23 nt, Homo sapiens
cuaucggaggcgcuuucccugcu

SEQ ID NO: 2511 - RNA, 23 nt, Homo sapiens
uaucggaggcgcuuucccugcuc

SEQ ID NO: 2512 - RNA, 23 nt, Homo sapiens
aucggaggcgcuuucccugcucc

SEQ ID NO: 2513 - RNA, 23 nt, Homo sapiens
ucggaggcgcuuucccugcuccu

SEQ ID NO: 2514 - RNA, 23 nt, Homo sapiens
cggaggcgcuuucccugcuccug

SEQ ID NO: 2515 - RNA, 23 nt, Homo sapiens
ggaggcgcuuucccugcuccugu

SEQ ID NO: 2516 - RNA, 23 nt, Homo sapiens
gaggcgcuuucccugcuccuguu

SEQ ID NO: 2517 - RNA, 23 nt, Homo sapiens
aggcgcuuucccugcuccuguuc

SEQ ID NO: 2518 - RNA, 23 nt, Homo sapiens
ggcgcuuucccugcuccuguucg

SEQ ID NO: 2519 - RNA, 23 nt, Homo sapiens
gcgcuuucccugcuccuguucgc

SEQ ID NO: 2520 - RNA, 23 nt, Homo sapiens
cgcuuucccugcuccuguucgcc

SEQ ID NO: 2521 - RNA, 23 nt, Homo sapiens
gcuuucccugcuccuguucgccg

SEQ ID NO: 2522 - RNA, 23 nt, Homo sapiens
cuuucccugcuccuguucgccgu

SEQ ID NO: 2523 - RNA, 23 nt, Homo sapiens
uuucccugcuccuguucgccguu

SEQ ID NO: 2524 - RNA, 23 nt, Homo sapiens
uucccugcuccuguucgccguug

SEQ ID NO: 2525 - RNA, 23 nt, Homo sapiens
ucccugcuccuguucgccguugu

SEQ ID NO: 2526 - RNA, 23 nt, Homo sapiens
cccugcuccuguucgccguuguu

SEQ ID NO: 2527 - RNA, 23 nt, Homo sapiens
ccugcuccuguucgccguuguuc

SEQ ID NO: 2528 - RNA, 23 nt, Homo sapiens
cugcuccuguucgccguuguucu

SEQ ID NO: 2529 - RNA, 23 nt, Homo sapiens
ugcuccuguucgccguuguucug

SEQ ID NO: 2530 - RNA, 23 nt, Homo sapiens
gcuccuguucgccguuguucugu

SEQ ID NO: 2531 - RNA, 23 nt, Homo sapiens
cuccuguucgccguuguucuguc

SEQ ID NO: 2532 - RNA, 23 nt, Homo sapiens
uccuguucgccguuguucugucu

SEQ ID NO: 2533 - RNA, 23 nt, Homo sapiens
ccuguucgccguuguucugucuc

SEQ ID NO: 2534 - RNA, 23 nt, Homo sapiens
cuguucgccguuguucugucucg

SEQ ID NO: 2535 - RNA, 23 nt, Homo sapiens
uguucgccguuguucugucucgu

SEQ ID NO: 2536 - RNA, 23 nt, Homo sapiens
guucgccguuguucugucucgug

SEQ ID NO: 2537 - RNA, 23 nt, Homo sapiens
uucgccguuguucugucucgugc

SEQ ID NO: 2538 - RNA, 23 nt, Homo sapiens
ucgccguuguucugucucgugcc

SEQ ID NO: 2539 - RNA, 23 nt, Homo sapiens
cgccguuguucugucucgugccg

SEQ ID NO: 2540 - RNA, 23 nt, Homo sapiens
gccguuguucugucucgugccgc

SEQ ID NO: 2541 - RNA, 23 nt, Homo sapiens
ccguuguucugucucgugccgcc

SEQ ID NO: 2542 - RNA, 23 nt, Homo sapiens
cguuguucugucucgugccgccg

SEQ ID NO: 2543 - RNA, 23 nt, Homo sapiens
guuguucugucucgugccgccgc

SEQ ID NO: 2544 - RNA, 23 nt, Homo sapiens
uuguucugucucgugccgccgcc

SEQ ID NO: 2545 - RNA, 23 nt, Homo sapiens
uguucugucucgugccgccgccc

SEQ ID NO: 2546 - RNA, 23 nt, Homo sapiens
guucugucucgugccgccgcccu

SEQ ID NO: 2547 - RNA, 23 nt, Homo sapiens
uucugucucgugccgccgcccug

SEQ ID NO: 2548 - RNA, 23 nt, Homo sapiens
ucugucucgugccgccgcccugg

SEQ ID NO: 2549 - RNA, 23 nt, Homo sapiens
cugucucgugccgccgcccuggg

SEQ ID NO: 2550 - RNA, 23 nt, Homo sapiens
ugucucgugccgccgcccugggc

SEQ ID NO: 2551 - RNA, 23 nt, Homo sapiens
gucucgugccgccgcccugggcu

SEQ ID NO: 2552 - RNA, 23 nt, Homo sapiens
ucucgugccgccgcccugggcug

SEQ ID NO: 2553 - RNA, 23 nt, Homo sapiens
cucgugccgccgcccugggcugc

SEQ ID NO: 2554 - RNA, 23 nt, Homo sapiens
ucgugccgccgcccugggcugca

SEQ ID NO: 2555 - RNA, 23 nt, Homo sapiens
cgugccgccgcccugggcugcau

SEQ ID NO: 2556 - RNA, 23 nt, Homo sapiens
gugccgccgcccugggcugcauu

SEQ ID NO: 2557 - RNA, 23 nt, Homo sapiens
ugccgccgcccugggcugcauug

SEQ ID NO: 2558 - RNA, 23 nt, Homo sapiens
gccgccgcccugggcugcauugg

SEQ ID NO: 2559 - RNA, 23 nt, Homo sapiens
ccgccgcccugggcugcauuggg

SEQ ID NO: 2560 - RNA, 23 nt, Homo sapiens
cgccgcccugggcugcauugggu

SEQ ID NO: 2561 - RNA, 23 nt, Homo sapiens
gccgcccugggcugcauuggguu

SEQ ID NO: 2562 - RNA, 23 nt, Homo sapiens
ccgcccugggcugcauuggguug

SEQ ID NO: 2563 - RNA, 23 nt, Homo sapiens
cgcccugggcugcauuggguugg

SEQ ID NO: 2564 - RNA, 23 nt, Homo sapiens
gcccugggcugcauuggguuggu

SEQ ID NO: 2565 - RNA, 23 nt, Homo sapiens
cccugggcugcauuggguuggug

SEQ ID NO: 2566 - RNA, 23 nt, Homo sapiens
ccugggcugcauuggguuggugg

SEQ ID NO: 2567 - RNA, 23 nt, Homo sapiens
cugggcugcauuggguugguggc

SEQ ID NO: 2568 - RNA, 23 nt, Homo sapiens
ugggcugcauuggguugguggcc

SEQ ID NO: 2569 - RNA, 23 nt, Homo sapiens
gggcugcauuggguugguggccc

SEQ ID NO: 2570 - RNA, 23 nt, Homo sapiens
ggcugcauuggguugguggccca

SEQ ID NO: 2571 - RNA, 23 nt, Homo sapiens
gcugcauuggguugguggcccac

SEQ ID NO: 2572 - RNA, 23 nt, Homo sapiens
cugcauuggguugguggcccacg

SEQ ID NO: 2573 - RNA, 23 nt, Homo sapiens
ugcauuggguugguggcccacgc

SEQ ID NO: 2574 - RNA, 23 nt, Homo sapiens
gcauuggguugguggcccacgcc

SEQ ID NO: 2575 - RNA, 23 nt, Homo sapiens
cauuggguugguggcccacgccg

SEQ ID NO: 2576 - RNA, 23 nt, Homo sapiens
auuggguugguggcccacgccgg

SEQ ID NO: 2577 - RNA, 23 nt, Homo sapiens
uuggguugguggcccacgccggc

SEQ ID NO: 2578 - RNA, 23 nt, Homo sapiens
uggguugguggcccacgccggcc

SEQ ID NO: 2579 - RNA, 23 nt, Homo sapiens
ggguugguggcccacgccggcca

SEQ ID NO: 2580 - RNA, 23 nt, Homo sapiens
gguugguggcccacgccggccaa

SEQ ID NO: 2581 - RNA, 23 nt, Homo sapiens
guugguggcccacgccggccaac

SEQ ID NO: 2582 - RNA, 23 nt, Homo sapiens
uugguggcccacgccggccaacu

SEQ ID NO: 2583 - RNA, 23 nt, Homo sapiens
ugguggcccacgccggccaacuc

SEQ ID NO: 2584 - RNA, 23 nt, Homo sapiens
gguggcccacgccggccaacuca

SEQ ID NO: 2585 - RNA, 23 nt, Homo sapiens
guggcccacgccggccaacucac

SEQ ID NO: 2586 - RNA, 23 nt, Homo sapiens
uggcccacgccggccaacucacc

SEQ ID NO: 2587 - RNA, 23 nt, Homo sapiens
ggcccacgccggccaacucaccg

SEQ ID NO: 2588 - RNA, 23 nt, Homo sapiens
gcccacgccggccaacucaccgc

SEQ ID NO: 2589 - RNA, 23 nt, Homo sapiens
cccacgccggccaacucaccgca

SEQ ID NO: 2590 - RNA, 23 nt, Homo sapiens
ccacgccggccaacucaccgcag

SEQ ID NO: 2591 - RNA, 23 nt, Homo sapiens
cacgccggccaacucaccgcagu

SEQ ID NO: 2592 - RNA, 23 nt, Homo sapiens
acgccggccaacucaccgcaguc

SEQ ID NO: 2593 - RNA, 23 nt, Homo sapiens
cgccggccaacucaccgcagucu

SEQ ID NO: 2594 - RNA, 23 nt, Homo sapiens
gccggccaacucaccgcagucug

SEQ ID NO: 2595 - RNA, 23 nt, Homo sapiens
ccggccaacucaccgcagucugg

SEQ ID NO: 2596 - RNA, 23 nt, Homo sapiens
cggccaacucaccgcagucuggc

SEQ ID NO: 2597 - RNA, 23 nt, Homo sapiens
ggccaacucaccgcagucuggcg

SEQ ID NO: 2598 - RNA, 23 nt, Homo sapiens
gccaacucaccgcagucuggcgc

SEQ ID NO: 2599 - RNA, 23 nt, Homo sapiens
ccaacucaccgcagucuggcgcc

SEQ ID NO: 2600 - RNA, 23 nt, Homo sapiens
caacucaccgcagucuggcgccg

SEQ ID NO: 2601 - RNA, 23 nt, Homo sapiens
aacucaccgcagucuggcgccgc

SEQ ID NO: 2602 - RNA, 23 nt, Homo sapiens
acucaccgcagucuggcgccgcc

SEQ ID NO: 2603 - RNA, 23 nt, Homo sapiens
cucaccgcagucuggcgccgccc

SEQ ID NO: 2604 - RNA, 23 nt, Homo sapiens
ucaccgcagucuggcgccgccca

SEQ ID NO: 2605 - RNA, 23 nt, Homo sapiens
caccgcagucuggcgccgcccag

SEQ ID NO: 2606 - RNA, 23 nt, Homo sapiens
accgcagucuggcgccgcccagg

SEQ ID NO: 2607 - RNA, 23 nt, Homo sapiens
ccgcagucuggcgccgcccagga

SEQ ID NO: 2608 - RNA, 23 nt, Homo sapiens
cgcagucuggcgccgcccaggag

SEQ ID NO: 2609 - RNA, 23 nt, Homo sapiens
gcagucuggcgccgcccaggagc

SEQ ID NO: 2610 - RNA, 23 nt, Homo sapiens
cagucuggcgccgcccaggagcc

SEQ ID NO: 2611 - RNA, 23 nt, Homo sapiens
agucuggcgccgcccaggagccg

SEQ ID NO: 2612 - RNA, 23 nt, Homo sapiens
gucuggcgccgcccaggagccgc

SEQ ID NO: 2613 - RNA, 23 nt, Homo sapiens
ucuggcgccgcccaggagccgcc

SEQ ID NO: 2614 - RNA, 23 nt, Homo sapiens
cuggcgccgcccaggagccgccc

SEQ ID NO: 2615 - RNA, 23 nt, Homo sapiens
uggcgccgcccaggagccgcccg

SEQ ID NO: 2616 - RNA, 23 nt, Homo sapiens
ggcgccgcccaggagccgcccgc

SEQ ID NO: 2617 - RNA, 23 nt, Homo sapiens
gcgccgcccaggagccgcccgcg

SEQ ID NO: 2618 - RNA, 23 nt, Homo sapiens
cgccgcccaggagccgcccgcgc

SEQ ID NO: 2619 - RNA, 23 nt, Homo sapiens
gccgcccaggagccgcccgcgcu

SEQ ID NO: 2620 - RNA, 23 nt, Homo sapiens
ccgcccaggagccgcccgcgcuc

SEQ ID NO: 2621 - RNA, 23 nt, Homo sapiens
cgcccaggagccgcccgcgcucc

SEQ ID NO: 2622 - RNA, 23 nt, Homo sapiens
gcccaggagccgcccgcgcuccc

SEQ ID NO: 2623 - RNA, 23 nt, Homo sapiens
cccaggagccgcccgcgcucccu

SEQ ID NO: 2624 - RNA, 23 nt, Homo sapiens
ccaggagccgcccgcgcucccug

SEQ ID NO: 2625 - RNA, 23 nt, Homo sapiens
caggagccgcccgcgcucccuga

SEQ ID NO: 2626 - RNA, 23 nt, Homo sapiens
aggagccgcccgcgcucccugaa

SEQ ID NO: 2627 - RNA, 23 nt, Homo sapiens
ggagccgcccgcgcucccugaac

SEQ ID NO: 2628 - RNA, 23 nt, Homo sapiens
gagccgcccgcgcucccugaacc

SEQ ID NO: 2629 - RNA, 23 nt, Homo sapiens
agccgcccgcgcucccugaaccc

SEQ ID NO: 2630 - RNA, 23 nt, Homo sapiens
gccgcccgcgcucccugaacccu

SEQ ID NO: 2631 - RNA, 23 nt, Homo sapiens
ccgcccgcgcucccugaacccua

SEQ ID NO: 2632 - RNA, 23 nt, Homo sapiens
cgcccgcgcucccugaacccuag

SEQ ID NO: 2633 - RNA, 23 nt, Homo sapiens
gcccgcgcucccugaacccuaga

SEQ ID NO: 2634 - RNA, 23 nt, Homo sapiens
cccgcgcucccugaacccuagaa

SEQ ID NO: 2635 - RNA, 23 nt, Homo sapiens
ccgcgcucccugaacccuagaac

SEQ ID NO: 2636 - RNA, 23 nt, Homo sapiens
cgcgcucccugaacccuagaacu

SEQ ID NO: 2637 - RNA, 23 nt, Homo sapiens
gcgcucccugaacccuagaacug

SEQ ID NO: 2638 - RNA, 23 nt, Homo sapiens
cgcucccugaacccuagaacugu

SEQ ID NO: 2639 - RNA, 23 nt, Homo sapiens
gcucccugaacccuagaacuguc

SEQ ID NO: 2640 - RNA, 23 nt, Homo sapiens
cucccugaacccuagaacugucu

SEQ ID NO: 2641 - RNA, 23 nt, Homo sapiens
ucccugaacccuagaacugucuu

SEQ ID NO: 2642 - RNA, 23 nt, Homo sapiens
cccugaacccuagaacugucuuc

SEQ ID NO: 2643 - RNA, 23 nt, Homo sapiens
ccugaacccuagaacugucuucg

SEQ ID NO: 2644 - RNA, 23 nt, Homo sapiens
cugaacccuagaacugucuucga

SEQ ID NO: 2645 - RNA, 23 nt, Homo sapiens
ugaacccuagaacugucuucgac

SEQ ID NO: 2646 - RNA, 23 nt, Homo sapiens
gaacccuagaacugucuucgacu

SEQ ID NO: 2647 - RNA, 23 nt, Homo sapiens
aacccuagaacugucuucgacuc

SEQ ID NO: 2648 - RNA, 23 nt, Homo sapiens
acccuagaacugucuucgacucc

SEQ ID NO: 2649 - RNA, 23 nt, Homo sapiens
cccuagaacugucuucgacuccg

SEQ ID NO: 2650 - RNA, 23 nt, Homo sapiens
ccuagaacugucuucgacuccgg

SEQ ID NO: 2651 - RNA, 23 nt, Homo sapiens
cuagaacugucuucgacuccggg

SEQ ID NO: 2652 - RNA, 23 nt, Homo sapiens
uagaacugucuucgacuccgggg

SEQ ID NO: 2653 - RNA, 23 nt, Homo sapiens
agaacugucuucgacuccggggc

SEQ ID NO: 2654 - RNA, 23 nt, Homo sapiens
gaacugucuucgacuccggggcc

SEQ ID NO: 2655 - RNA, 23 nt, Homo sapiens
aacugucuucgacuccggggccc

SEQ ID NO: 2656 - RNA, 23 nt, Homo sapiens
acugucuucgacuccggggcccc

SEQ ID NO: 2657 - RNA, 23 nt, Homo sapiens
cugucuucgacuccggggccccg

SEQ ID NO: 2658 - RNA, 23 nt, Homo sapiens
ugucuucgacuccggggccccgu

SEQ ID NO: 2659 - RNA, 23 nt, Homo sapiens
gucuucgacuccggggccccguu

SEQ ID NO: 2660 - RNA, 23 nt, Homo sapiens
ucuucgacuccggggccccguug

SEQ ID NO: 2661 - RNA, 23 nt, Homo sapiens
cuucgacuccggggccccguugg

SEQ ID NO: 2662 - RNA, 23 nt, Homo sapiens
uucgacuccggggccccguugga

SEQ ID NO: 2663 - RNA, 23 nt, Homo sapiens
ucgacuccggggccccguuggaa

SEQ ID NO: 2664 - RNA, 23 nt, Homo sapiens
cgacuccggggccccguuggaag

SEQ ID NO: 2665 - RNA, 23 nt, Homo sapiens
gacuccggggccccguuggaaga

SEQ ID NO: 2666 - RNA, 23 nt, Homo sapiens
acuccggggccccguuggaagac

SEQ ID NO: 2667 - RNA, 23 nt, Homo sapiens
cuccggggccccguuggaagacu

SEQ ID NO: 2668 - RNA, 23 nt, Homo sapiens
uccggggccccguuggaagacug

SEQ ID NO: 2669 - RNA, 23 nt, Homo sapiens
ccggggccccguuggaagacuga

SEQ ID NO: 2670 - RNA, 23 nt, Homo sapiens
cggggccccguuggaagacugag

SEQ ID NO: 2671 - RNA, 23 nt, Homo sapiens
ggggccccguuggaagacugagu

SEQ ID NO: 2672 - RNA, 23 nt, Homo sapiens
gggccccguuggaagacugagug

SEQ ID NO: 2673 - RNA, 23 nt, Homo sapiens
ggccccguuggaagacugagugc

SEQ ID NO: 2674 - RNA, 23 nt, Homo sapiens
gccccguuggaagacugagugcc

SEQ ID NO: 2675 - RNA, 23 nt, Homo sapiens
ccccguuggaagacugagugccc

SEQ ID NO: 2676 - RNA, 23 nt, Homo sapiens
cccguuggaagacugagugcccg

SEQ ID NO: 2677 - RNA, 23 nt, Homo sapiens
ccguuggaagacugagugcccgg

SEQ ID NO: 2678 - RNA, 23 nt, Homo sapiens
cguuggaagacugagugcccggg

SEQ ID NO: 2679 - RNA, 23 nt, Homo sapiens
guuggaagacugagugcccgggg

SEQ ID NO: 2680 - RNA, 23 nt, Homo sapiens
uuggaagacugagugcccggggc

SEQ ID NO: 2681 - RNA, 23 nt, Homo sapiens
uggaagacugagugcccggggca

SEQ ID NO: 2682 - RNA, 23 nt, Homo sapiens
ggaagacugagugcccggggcac

SEQ ID NO: 2683 - RNA, 23 nt, Homo sapiens
gaagacugagugcccggggcacg

SEQ ID NO: 2684 - RNA, 23 nt, Homo sapiens
aagacugagugcccggggcacgg

SEQ ID NO: 2685 - RNA, 23 nt, Homo sapiens
agacugagugcccggggcacggc

SEQ ID NO: 2686 - RNA, 23 nt, Homo sapiens
gacugagugcccggggcacggca

SEQ ID NO: 2687 - RNA, 23 nt, Homo sapiens
acugagugcccggggcacggcac

SEQ ID NO: 2688 - RNA, 23 nt, Homo sapiens
cugagugcccggggcacggcaca

SEQ ID NO: 2689 - RNA, 23 nt, Homo sapiens
ugagugcccggggcacggcacag

SEQ ID NO: 2690 - RNA, 23 nt, Homo sapiens
gagugcccggggcacggcacaga

SEQ ID NO: 2691 - RNA, 23 nt, Homo sapiens
agugcccggggcacggcacagaa

SEQ ID NO: 2692 - RNA, 23 nt, Homo sapiens
gugcccggggcacggcacagaag

SEQ ID NO: 2693 - RNA, 23 nt, Homo sapiens
ugcccggggcacggcacagaagc

SEQ ID NO: 2694 - RNA, 23 nt, Homo sapiens
gcccggggcacggcacagaagcc

SEQ ID NO: 2695 - RNA, 23 nt, Homo sapiens
cccggggcacggcacagaagccg

SEQ ID NO: 2696 - RNA, 23 nt, Homo sapiens
ccggggcacggcacagaagccgc

SEQ ID NO: 2697 - RNA, 23 nt, Homo sapiens
cggggcacggcacagaagccgcg

SEQ ID NO: 2698 - RNA, 23 nt, Homo sapiens
ggggcacggcacagaagccgcgc

SEQ ID NO: 2699 - RNA, 23 nt, Homo sapiens
gggcacggcacagaagccgcgcc

SEQ ID NO: 2700 - RNA, 23 nt, Homo sapiens
ggcacggcacagaagccgcgccc

SEQ ID NO: 2701 - RNA, 23 nt, Homo sapiens
gcacggcacagaagccgcgccca

SEQ ID NO: 2702 - RNA, 23 nt, Homo sapiens
cacggcacagaagccgcgcccac

SEQ ID NO: 2703 - RNA, 23 nt, Homo sapiens
acggcacagaagccgcgcccacc

SEQ ID NO: 2704 - RNA, 23 nt, Homo sapiens
cggcacagaagccgcgcccaccg

SEQ ID NO: 2705 - RNA, 23 nt, Homo sapiens
ggcacagaagccgcgcccaccgc

SEQ ID NO: 2706 - RNA, 23 nt, Homo sapiens
gcacagaagccgcgcccaccgcc

SEQ ID NO: 2707 - RNA, 23 nt, Homo sapiens
cacagaagccgcgcccaccgccu

SEQ ID NO: 2708 - RNA, 23 nt, Homo sapiens
acagaagccgcgcccaccgccug

SEQ ID NO: 2709 - RNA, 23 nt, Homo sapiens
cagaagccgcgcccaccgccugc

SEQ ID NO: 2710 - RNA, 23 nt, Homo sapiens
agaagccgcgcccaccgccugcc

SEQ ID NO: 2711 - RNA, 23 nt, Homo sapiens
gaagccgcgcccaccgccugcca

SEQ ID NO: 2712 - RNA, 23 nt, Homo sapiens
aagccgcgcccaccgccugccag

SEQ ID NO: 2713 - RNA, 23 nt, Homo sapiens
agccgcgcccaccgccugccagu

SEQ ID NO: 2714 - RNA, 23 nt, Homo sapiens
gccgcgcccaccgccugccaguu

SEQ ID NO: 2715 - RNA, 23 nt, Homo sapiens
ccgcgcccaccgccugccaguuc

SEQ ID NO: 2716 - RNA, 23 nt, Homo sapiens
cgcgcccaccgccugccaguuca

SEQ ID NO: 2717 - RNA, 23 nt, Homo sapiens
gcgcccaccgccugccaguucac

SEQ ID NO: 2718 - RNA, 23 nt, Homo sapiens
cgcccaccgccugccaguucaca

SEQ ID NO: 2719 - RNA, 23 nt, Homo sapiens
gcccaccgccugccaguucacaa

SEQ ID NO: 2720 - RNA, 23 nt, Homo sapiens
cccaccgccugccaguucacaac

SEQ ID NO: 2721 - RNA, 23 nt, Homo sapiens
ccaccgccugccaguucacaacc

SEQ ID NO: 2722 - RNA, 23 nt, Homo sapiens
caccgccugccaguucacaaccg

SEQ ID NO: 2723 - RNA, 23 nt, Homo sapiens
accgccugccaguucacaaccgc

SEQ ID NO: 2724 - RNA, 23 nt, Homo sapiens
ccgccugccaguucacaaccgcu

SEQ ID NO: 2725 - RNA, 23 nt, Homo sapiens
cgccugccaguucacaaccgcuc

SEQ ID NO: 2726 - RNA, 23 nt, Homo sapiens
gccugccaguucacaaccgcucc

SEQ ID NO: 2727 - RNA, 23 nt, Homo sapiens
ccugccaguucacaaccgcuccg

SEQ ID NO: 2728 - RNA, 23 nt, Homo sapiens
cugccaguucacaaccgcuccga

SEQ ID NO: 2729 - RNA, 23 nt, Homo sapiens
ugccaguucacaaccgcuccgag

SEQ ID NO: 2730 - RNA, 23 nt, Homo sapiens
gccaguucacaaccgcuccgagc

SEQ ID NO: 2731 - RNA, 23 nt, Homo sapiens
ccaguucacaaccgcuccgagcg

SEQ ID NO: 2732 - RNA, 23 nt, Homo sapiens
caguucacaaccgcuccgagcgu

SEQ ID NO: 2733 - RNA, 23 nt, Homo sapiens
aguucacaaccgcuccgagcgug

SEQ ID NO: 2734 - RNA, 23 nt, Homo sapiens
guucacaaccgcuccgagcgugg

SEQ ID NO: 2735 - RNA, 23 nt, Homo sapiens
uucacaaccgcuccgagcguggg

SEQ ID NO: 2736 - RNA, 23 nt, Homo sapiens
ucacaaccgcuccgagcgugggu

SEQ ID NO: 2737 - RNA, 23 nt, Homo sapiens
cacaaccgcuccgagcguggguc

SEQ ID NO: 2738 - RNA, 23 nt, Homo sapiens
acaaccgcuccgagcgugggucu

SEQ ID NO: 2739 - RNA, 23 nt, Homo sapiens
caaccgcuccgagcgugggucuc

SEQ ID NO: 2740 - RNA, 23 nt, Homo sapiens
aaccgcuccgagcgugggucucc

SEQ ID NO: 2741 - RNA, 23 nt, Homo sapiens
accgcuccgagcgugggucuccg

SEQ ID NO: 2742 - RNA, 23 nt, Homo sapiens
ccgcuccgagcgugggucuccgc

SEQ ID NO: 2743 - RNA, 23 nt, Homo sapiens
cgcuccgagcgugggucuccgcc

SEQ ID NO: 2744 - RNA, 23 nt, Homo sapiens
gcuccgagcgugggucuccgccc

SEQ ID NO: 2745 - RNA, 23 nt, Homo sapiens
cuccgagcgugggucuccgccca

SEQ ID NO: 2746 - RNA, 23 nt, Homo sapiens
uccgagcgugggucuccgcccag

SEQ ID NO: 2747 - RNA, 23 nt, Homo sapiens
ccgagcgugggucuccgcccagc

SEQ ID NO: 2748 - RNA, 23 nt, Homo sapiens
cgagcgugggucuccgcccagcu

SEQ ID NO: 2749 - RNA, 23 nt, Homo sapiens
gagcgugggucuccgcccagcuc

SEQ ID NO: 2750 - RNA, 23 nt, Homo sapiens
agcgugggucuccgcccagcucc

SEQ ID NO: 2751 - RNA, 23 nt, Homo sapiens
gcgugggucuccgcccagcucca

SEQ ID NO: 2752 - RNA, 23 nt, Homo sapiens
cgugggucuccgcccagcuccag

SEQ ID NO: 2753 - RNA, 23 nt, Homo sapiens
gugggucuccgcccagcuccagu

SEQ ID NO: 2754 - RNA, 23 nt, Homo sapiens
ugggucuccgcccagcuccaguc

SEQ ID NO: 2755 - RNA, 23 nt, Homo sapiens
gggucuccgcccagcuccagucc

SEQ ID NO: 2756 - RNA, 23 nt, Homo sapiens
ggucuccgcccagcuccaguccu

SEQ ID NO: 2757 - RNA, 23 nt, Homo sapiens
gucuccgcccagcuccaguccug

SEQ ID NO: 2758 - RNA, 23 nt, Homo sapiens
ucuccgcccagcuccaguccugu

SEQ ID NO: 2759 - RNA, 23 nt, Homo sapiens
cuccgcccagcuccaguccugug

SEQ ID NO: 2760 - RNA, 23 nt, Homo sapiens
uccgcccagcuccaguccuguga

SEQ ID NO: 2761 - RNA, 23 nt, Homo sapiens
ccgcccagcuccaguccugugau

SEQ ID NO: 2762 - RNA, 23 nt, Homo sapiens
cgcccagcuccaguccugugauc

SEQ ID NO: 2763 - RNA, 23 nt, Homo sapiens
gcccagcuccaguccugugaucc

SEQ ID NO: 2764 - RNA, 23 nt, Homo sapiens
cccagcuccaguccugugauccg

SEQ ID NO: 2765 - RNA, 23 nt, Homo sapiens
ccagcuccaguccugugauccgg

SEQ ID NO: 2766 - RNA, 23 nt, Homo sapiens
cagcuccaguccugugauccggg

SEQ ID NO: 2767 - RNA, 23 nt, Homo sapiens
agcuccaguccugugauccgggc

SEQ ID NO: 2768 - RNA, 23 nt, Homo sapiens
gcuccaguccugugauccgggcc

SEQ ID NO: 2769 - RNA, 23 nt, Homo sapiens
cuccaguccugugauccgggccc

SEQ ID NO: 2770 - RNA, 23 nt, Homo sapiens
uccaguccugugauccgggcccg

SEQ ID NO: 2771 - RNA, 23 nt, Homo sapiens
ccaguccugugauccgggcccgc

SEQ ID NO: 2772 - RNA, 23 nt, Homo sapiens
caguccugugauccgggcccgcc

SEQ ID NO: 2773 - RNA, 23 nt, Homo sapiens
aguccugugauccgggcccgccc

SEQ ID NO: 2774 - RNA, 23 nt, Homo sapiens
guccugugauccgggcccgcccc

SEQ ID NO: 2775 - RNA, 23 nt, Homo sapiens
uccugugauccgggcccgccccc

SEQ ID NO: 2776 - RNA, 23 nt, Homo sapiens
ccugugauccgggcccgcccccu

SEQ ID NO: 2777 - RNA, 23 nt, Homo sapiens
cugugauccgggcccgcccccua

SEQ ID NO: 2778 - RNA, 23 nt, Homo sapiens
ugugauccgggcccgcccccuag

SEQ ID NO: 2779 - RNA, 23 nt, Homo sapiens
gugauccgggcccgcccccuagc

SEQ ID NO: 2780 - RNA, 23 nt, Homo sapiens
ugauccgggcccgcccccuagcg

SEQ ID NO: 2781 - RNA, 23 nt, Homo sapiens
gauccgggcccgcccccuagcgg

SEQ ID NO: 2782 - RNA, 23 nt, Homo sapiens
auccgggcccgcccccuagcggc

SEQ ID NO: 2783 - RNA, 23 nt, Homo sapiens
uccgggcccgcccccuagcggcc

SEQ ID NO: 2784 - RNA, 23 nt, Homo sapiens
ccgggcccgcccccuagcggccg

SEQ ID NO: 2785 - RNA, 23 nt, Homo sapiens
cgggcccgcccccuagcggccgg

SEQ ID NO: 2786 - RNA, 23 nt, Homo sapiens
gggcccgcccccuagcggccggg

SEQ ID NO: 2787 - RNA, 23 nt, Homo sapiens
ggcccgcccccuagcggccgggg

SEQ ID NO: 2788 - RNA, 23 nt, Homo sapiens
gcccgcccccuagcggccgggga

SEQ ID NO: 2789 - RNA, 23 nt, Homo sapiens
cccgcccccuagcggccggggag

SEQ ID NO: 2790 - RNA, 23 nt, Homo sapiens
ccgcccccuagcggccggggagg

SEQ ID NO: 2791 - RNA, 23 nt, Homo sapiens
cgcccccuagcggccggggaggg

SEQ ID NO: 2792 - RNA, 23 nt, Homo sapiens
gcccccuagcggccggggaggga

SEQ ID NO: 2793 - RNA, 23 nt, Homo sapiens
cccccuagcggccggggagggag

SEQ ID NO: 2794 - RNA, 23 nt, Homo sapiens
ccccuagcggccggggagggagg

SEQ ID NO: 2795 - RNA, 23 nt, Homo sapiens
cccuagcggccggggagggaggg

SEQ ID NO: 2796 - RNA, 23 nt, Homo sapiens
ccuagcggccggggagggagggg

SEQ ID NO: 2797 - RNA, 23 nt, Homo sapiens
cuagcggccggggagggaggggc

SEQ ID NO: 2798 - RNA, 23 nt, Homo sapiens
uagcggccggggagggaggggcc

SEQ ID NO: 2799 - RNA, 23 nt, Homo sapiens
agcggccggggagggaggggccg

SEQ ID NO: 2800 - RNA, 23 nt, Homo sapiens
gcggccggggagggaggggccgg

SEQ ID NO: 2801 - RNA, 23 nt, Homo sapiens
cggccggggagggaggggccggg

SEQ ID NO: 2802 - RNA, 23 nt, Homo sapiens
ggccggggagggaggggccgggu

SEQ ID NO: 2803 - RNA, 23 nt, Homo sapiens
gccggggagggaggggccggguc

SEQ ID NO: 2804 - RNA, 23 nt, Homo sapiens
ccggggagggaggggccgggucc

SEQ ID NO: 2805 - RNA, 23 nt, Homo sapiens
cggggagggaggggccggguccg

SEQ ID NO: 2806 - RNA, 23 nt, Homo sapiens
ggggagggaggggccggguccgc

SEQ ID NO: 2807 - RNA, 23 nt, Homo sapiens
gggagggaggggccggguccgcg

SEQ ID NO: 2808 - RNA, 23 nt, Homo sapiens
ggagggaggggccggguccgcgg

SEQ ID NO: 2809 - RNA, 23 nt, Homo sapiens
gagggaggggccggguccgcggc

SEQ ID NO: 2810 - RNA, 23 nt, Homo sapiens
agggaggggccggguccgcggcc

SEQ ID NO: 2811 - RNA, 23 nt, Homo sapiens
gggaggggccggguccgcggccg

SEQ ID NO: 2812 - RNA, 23 nt, Homo sapiens
ggaggggccggguccgcggccgg

SEQ ID NO: 2813 - RNA, 23 nt, Homo sapiens
gaggggccggguccgcggccggc

SEQ ID NO: 2814 - RNA, 23 nt, Homo sapiens
aggggccggguccgcggccggcg

SEQ ID NO: 2815 - RNA, 23 nt, Homo sapiens
ggggccggguccgcggccggcga

SEQ ID NO: 2816 - RNA, 23 nt, Homo sapiens
gggccggguccgcggccggcgaa

SEQ ID NO: 2817 - RNA, 23 nt, Homo sapiens
ggccggguccgcggccggcgaac

SEQ ID NO: 2818 - RNA, 23 nt, Homo sapiens
gccggguccgcggccggcgaacg

SEQ ID NO: 2819 - RNA, 23 nt, Homo sapiens
ccggguccgcggccggcgaacgg

SEQ ID NO: 2820 - RNA, 23 nt, Homo sapiens
cggguccgcggccggcgaacggg

SEQ ID NO: 2821 - RNA, 23 nt, Homo sapiens
ggguccgcggccggcgaacgggg

SEQ ID NO: 2822 - RNA, 23 nt, Homo sapiens
gguccgcggccggcgaacggggc

SEQ ID NO: 2823 - RNA, 23 nt, Homo sapiens
guccgcggccggcgaacggggcu

SEQ ID NO: 2824 - RNA, 23 nt, Homo sapiens
uccgcggccggcgaacggggcuc

SEQ ID NO: 2825 - RNA, 23 nt, Homo sapiens
ccgcggccggcgaacggggcucg

SEQ ID NO: 2826 - RNA, 23 nt, Homo sapiens
cgcggccggcgaacggggcucga

SEQ ID NO: 2827 - RNA, 23 nt, Homo sapiens
gcggccggcgaacggggcucgaa

SEQ ID NO: 2828 - RNA, 23 nt, Homo sapiens
cggccggcgaacggggcucgaag

SEQ ID NO: 2829 - RNA, 23 nt, Homo sapiens
ggccggcgaacggggcucgaagg

SEQ ID NO: 2830 - RNA, 23 nt, Homo sapiens
gccggcgaacggggcucgaaggg

SEQ ID NO: 2831 - RNA, 23 nt, Homo sapiens
ccggcgaacggggcucgaagggu

SEQ ID NO: 2832 - RNA, 23 nt, Homo sapiens
cggcgaacggggcucgaaggguc

SEQ ID NO: 2833 - RNA, 23 nt, Homo sapiens
ggcgaacggggcucgaagggucc

SEQ ID NO: 2834 - RNA, 23 nt, Homo sapiens
gcgaacggggcucgaaggguccu

SEQ ID NO: 2835 - RNA, 23 nt, Homo sapiens
cgaacggggcucgaaggguccuu

SEQ ID NO: 2836 - RNA, 23 nt, Homo sapiens
gaacggggcucgaaggguccuug

SEQ ID NO: 2837 - RNA, 23 nt, Homo sapiens
aacggggcucgaaggguccuugu

SEQ ID NO: 2838 - RNA, 23 nt, Homo sapiens
acggggcucgaaggguccuugua

SEQ ID NO: 2839 - RNA, 23 nt, Homo sapiens
cggggcucgaaggguccuuguag

SEQ ID NO: 2840 - RNA, 23 nt, Homo sapiens
ggggcucgaaggguccuuguagc

SEQ ID NO: 2841 - RNA, 23 nt, Homo sapiens
gggcucgaaggguccuuguagcc

SEQ ID NO: 2842 - RNA, 23 nt, Homo sapiens
ggcucgaaggguccuuguagccg

SEQ ID NO: 2843 - RNA, 23 nt, Homo sapiens
gcucgaaggguccuuguagccgg

SEQ ID NO: 2844 - RNA, 23 nt, Homo sapiens
cucgaaggguccuuguagccggg

SEQ ID NO: 2845 - RNA, 23 nt, Homo sapiens
ucgaaggguccuuguagccggga

SEQ ID NO: 2846 - RNA, 23 nt, Homo sapiens
cgaaggguccuuguagccgggaa

SEQ ID NO: 2847 - RNA, 23 nt, Homo sapiens
gaaggguccuuguagccgggaau

SEQ ID NO: 2848 - RNA, 23 nt, Homo sapiens
aaggguccuuguagccgggaaug

SEQ ID NO: 2849 - RNA, 23 nt, Homo sapiens
aggguccuuguagccgggaaugc

SEQ ID NO: 2850 - RNA, 23 nt, Homo sapiens
ggguccuuguagccgggaaugcu

SEQ ID NO: 2851 - RNA, 23 nt, Homo sapiens
gguccuuguagccgggaaugcug

SEQ ID NO: 2852 - RNA, 23 nt, Homo sapiens
guccuuguagccgggaaugcugc

SEQ ID NO: 2853 - RNA, 23 nt, Homo sapiens
uccuuguagccgggaaugcugcu

SEQ ID NO: 2854 - RNA, 23 nt, Homo sapiens
ccuuguagccgggaaugcugcug

SEQ ID NO: 2855 - RNA, 23 nt, Homo sapiens
cuuguagccgggaaugcugcugc

SEQ ID NO: 2856 - RNA, 23 nt, Homo sapiens
uuguagccgggaaugcugcugcu

SEQ ID NO: 2857 - RNA, 23 nt, Homo sapiens
uguagccgggaaugcugcugcug

SEQ ID NO: 2858 - RNA, 23 nt, Homo sapiens
guagccgggaaugcugcugcugc

SEQ ID NO: 2859 - RNA, 23 nt, Homo sapiens
uagccgggaaugcugcugcugcu

SEQ ID NO: 2860 - RNA, 23 nt, Homo sapiens
agccgggaaugcugcugcugcug

SEQ ID NO: 2861 - RNA, 23 nt, Homo sapiens
gccgggaaugcugcugcugcugc

SEQ ID NO: 2862 - RNA, 23 nt, Homo sapiens
ccgggaaugcugcugcugcugcu

SEQ ID NO: 2863 - RNA, 23 nt, Homo sapiens
cgggaaugcugcugcugcugcug

SEQ ID NO: 2864 - RNA, 23 nt, Homo sapiens
gggaaugcugcugcugcugcugc

SEQ ID NO: 2865 - RNA, 23 nt, Homo sapiens
ggaaugcugcugcugcugcugcu

SEQ ID NO: 2866 - RNA, 23 nt, Homo sapiens
gaaugcugcugcugcugcugcug

SEQ ID NO: 2867 - RNA, 23 nt, Homo sapiens
aaugcugcugcugcugcugcugc

SEQ ID NO: 2868 - RNA, 23 nt, Homo sapiens
augcugcugcugcugcugcugcu

SEQ ID NO: 2869 - RNA, 23 nt, Homo sapiens
ugcugcugcugcugcugcugcug

SEQ ID NO: 2870 - RNA, 23 nt, Homo sapiens
gcugcugcugcugcugcugcugc

SEQ ID NO: 2871 - RNA, 23 nt, Homo sapiens
cugcugcugcugcugcugcugcu

SEQ ID NO: 2872 - RNA, 23 nt, Homo sapiens
ugcugcugcugcugcugcugcug

SEQ ID NO: 2873 - RNA, 23 nt, Homo sapiens
gcugcugcugcugcugcugcugc

SEQ ID NO: 2874 - RNA, 23 nt, Homo sapiens
cugcugcugcugcugcugcugcu

SEQ ID NO: 2875 - RNA, 23 nt, Homo sapiens
ugcugcugcugcugcugcugcug

SEQ ID NO: 2876 - RNA, 23 nt, Homo sapiens
gcugcugcugcugcugcugcugc

SEQ ID NO: 2877 - RNA, 23 nt, Homo sapiens
cugcugcugcugcugcugcugcu

SEQ ID NO: 2878 - RNA, 23 nt, Homo sapiens
ugcugcugcugcugcugcugcug

SEQ ID NO: 2879 - RNA, 23 nt, Homo sapiens
gcugcugcugcugcugcugcugc

SEQ ID NO: 2880 - RNA, 23 nt, Homo sapiens
cugcugcugcugcugcugcugcu

SEQ ID NO: 2881 - RNA, 23 nt, Homo sapiens
ugcugcugcugcugcugcugcug

SEQ ID NO: 2882 - RNA, 23 nt, Homo sapiens
gcugcugcugcugcugcugcugc

SEQ ID NO: 2883 - RNA, 23 nt, Homo sapiens
cugcugcugcugcugcugcugcu

SEQ ID NO: 2884 - RNA, 23 nt, Homo sapiens
ugcugcugcugcugcugcugcug

SEQ ID NO: 2885 - RNA, 23 nt, Homo sapiens
gcugcugcugcugcugcugcugc

SEQ ID NO: 2886 - RNA, 23 nt, Homo sapiens
cugcugcugcugcugcugcugcu

SEQ ID NO: 2887 - RNA, 23 nt, Homo sapiens
ugcugcugcugcugcugcugcug

SEQ ID NO: 2888 - RNA, 23 nt, Homo sapiens
gcugcugcugcugcugcugcugc

SEQ ID NO: 2889 - RNA, 23 nt, Homo sapiens
cugcugcugcugcugcugcugcu

SEQ ID NO: 2890 - RNA, 23 nt, Homo sapiens
ugcugcugcugcugcugcugcug

SEQ ID NO: 2891 - RNA, 23 nt, Homo sapiens
gcugcugcugcugcugcugcugc

SEQ ID NO: 2892 - RNA, 23 nt, Homo sapiens
cugcugcugcugcugcugcugcu

SEQ ID NO: 2893 - RNA, 23 nt, Homo sapiens
ugcugcugcugcugcugcugcug

SEQ ID NO: 2894 - RNA, 23 nt, Homo sapiens
gcugcugcugcugcugcugcugc

SEQ ID NO: 2895 - RNA, 23 nt, Homo sapiens
cugcugcugcugcugcugcugcu

SEQ ID NO: 2896 - RNA, 23 nt, Homo sapiens
ugcugcugcugcugcugcugcug

SEQ ID NO: 2897 - RNA, 23 nt, Homo sapiens
gcugcugcugcugcugcugcugc

SEQ ID NO: 2898 - RNA, 23 nt, Homo sapiens
cugcugcugcugcugcugcugcu

SEQ ID NO: 2899 - RNA, 23 nt, Homo sapiens
ugcugcugcugcugcugcugcug

SEQ ID NO: 2900 - RNA, 23 nt, Homo sapiens
gcugcugcugcugcugcugcugc

SEQ ID NO: 2901 - RNA, 23 nt, Homo sapiens
cugcugcugcugcugcugcugcu

SEQ ID NO: 2902 - RNA, 23 nt, Homo sapiens
ugcugcugcugcugcugcugcug

SEQ ID NO: 2903 - RNA, 23 nt, Homo sapiens
gcugcugcugcugcugcugcugc

SEQ ID NO: 2904 - RNA, 23 nt, Homo sapiens
cugcugcugcugcugcugcugcu

SEQ ID NO: 2905 - RNA, 23 nt, Homo sapiens
ugcugcugcugcugcugcugcug

SEQ ID NO: 2906 - RNA, 23 nt, Homo sapiens
gcugcugcugcugcugcugcugc

SEQ ID NO: 2907 - RNA, 23 nt, Homo sapiens
cugcugcugcugcugcugcugcu

SEQ ID NO: 2908 - RNA, 23 nt, Homo sapiens
ugcugcugcugcugcugcugcug

SEQ ID NO: 2909 - RNA, 23 nt, Homo sapiens
gcugcugcugcugcugcugcugg

SEQ ID NO: 2910 - RNA, 23 nt, Homo sapiens
cugcugcugcugcugcugcuggg

SEQ ID NO: 2911 - RNA, 23 nt, Homo sapiens
ugcugcugcugcugcugcugggg

SEQ ID NO: 2912 - RNA, 23 nt, Homo sapiens
gcugcugcugcugcugcuggggg

SEQ ID NO: 2913 - RNA, 23 nt, Homo sapiens
cugcugcugcugcugcugggggg

SEQ ID NO: 2914 - RNA, 23 nt, Homo sapiens
ugcugcugcugcugcugggggga

SEQ ID NO: 2915 - RNA, 23 nt, Homo sapiens
gcugcugcugcugcuggggggau

SEQ ID NO: 2916 - RNA, 23 nt, Homo sapiens
cugcugcugcugcuggggggauc

SEQ ID NO: 2917 - RNA, 23 nt, Homo sapiens
ugcugcugcugcuggggggauca

SEQ ID NO: 2918 - RNA, 23 nt, Homo sapiens
gcugcugcugcuggggggaucac

SEQ ID NO: 2919 - RNA, 23 nt, Homo sapiens
cugcugcugcuggggggaucaca

SEQ ID NO: 2920 - RNA, 23 nt, Homo sapiens
ugcugcugcuggggggaucacag

SEQ ID NO: 2921 - RNA, 23 nt, Homo sapiens
gcugcugcuggggggaucacaga

SEQ ID NO: 2922 - RNA, 23 nt, Homo sapiens
cugcugcuggggggaucacagac

SEQ ID NO: 2923 - RNA, 23 nt, Homo sapiens
ugcugcuggggggaucacagacc

SEQ ID NO: 2924 - RNA, 23 nt, Homo sapiens
gcugcuggggggaucacagacca

SEQ ID NO: 2925 - RNA, 23 nt, Homo sapiens
cugcuggggggaucacagaccau

SEQ ID NO: 2926 - RNA, 23 nt, Homo sapiens
ugcuggggggaucacagaccauu

SEQ ID NO: 2927 - RNA, 23 nt, Homo sapiens
gcuggggggaucacagaccauuu

SEQ ID NO: 2928 - RNA, 23 nt, Homo sapiens
cuggggggaucacagaccauuuc

SEQ ID NO: 2929 - RNA, 23 nt, Homo sapiens
uggggggaucacagaccauuucu

SEQ ID NO: 2930 - RNA, 23 nt, Homo sapiens
ggggggaucacagaccauuucuu

SEQ ID NO: 2931 - RNA, 23 nt, Homo sapiens
gggggaucacagaccauuucuuu

SEQ ID NO: 2932 - RNA, 23 nt, Homo sapiens
ggggaucacagaccauuucuuuc

SEQ ID NO: 2933 - RNA, 23 nt, Homo sapiens
gggaucacagaccauuucuuucu

SEQ ID NO: 2934 - RNA, 23 nt, Homo sapiens
ggaucacagaccauuucuuucuu

SEQ ID NO: 2935 - RNA, 23 nt, Homo sapiens
gaucacagaccauuucuuucuuu

SEQ ID NO: 2936 - RNA, 23 nt, Homo sapiens
aucacagaccauuucuuucuuuc

SEQ ID NO: 2937 - RNA, 23 nt, Homo sapiens
ucacagaccauuucuuucuuucg

SEQ ID NO: 2938 - RNA, 23 nt, Homo sapiens
cacagaccauuucuuucuuucgg

SEQ ID NO: 2939 - RNA, 23 nt, Homo sapiens
acagaccauuucuuucuuucggc

SEQ ID NO: 2940 - RNA, 23 nt, Homo sapiens
cagaccauuucuuucuuucggcc

SEQ ID NO: 2941 - RNA, 23 nt, Homo sapiens
agaccauuucuuucuuucggcca

SEQ ID NO: 2942 - RNA, 23 nt, Homo sapiens
gaccauuucuuucuuucggccag

SEQ ID NO: 2943 - RNA, 23 nt, Homo sapiens
accauuucuuucuuucggccagg

SEQ ID NO: 2944 - RNA, 23 nt, Homo sapiens
ccauuucuuucuuucggccaggc

SEQ ID NO: 2945 - RNA, 23 nt, Homo sapiens
cauuucuuucuuucggccaggcu

SEQ ID NO: 2946 - RNA, 23 nt, Homo sapiens
auuucuuucuuucggccaggcug

SEQ ID NO: 2947 - RNA, 23 nt, Homo sapiens
uuucuuucuuucggccaggcuga

SEQ ID NO: 2948 - RNA, 23 nt, Homo sapiens
uucuuucuuucggccaggcugag

SEQ ID NO: 2949 - RNA, 23 nt, Homo sapiens
ucuuucuuucggccaggcugagg

SEQ ID NO: 2950 - RNA, 23 nt, Homo sapiens
cuuucuuucggccaggcugaggc

SEQ ID NO: 2951 - RNA, 23 nt, Homo sapiens
uuucuuucggccaggcugaggcc

SEQ ID NO: 2952 - RNA, 23 nt, Homo sapiens
uucuuucggccaggcugaggccc

SEQ ID NO: 2953 - RNA, 23 nt, Homo sapiens
ucuuucggccaggcugaggcccu

SEQ ID NO: 2954 - RNA, 23 nt, Homo sapiens
cuuucggccaggcugaggcccug

SEQ ID NO: 2955 - RNA, 23 nt, Homo sapiens
uuucggccaggcugaggcccuga

SEQ ID NO: 2956 - RNA, 23 nt, Homo sapiens
uucggccaggcugaggcccugac

SEQ ID NO: 2957 - RNA, 23 nt, Homo sapiens
ucggccaggcugaggcccugacg

SEQ ID NO: 2958 - RNA, 23 nt, Homo sapiens
cggccaggcugaggcccugacgu

SEQ ID NO: 2959 - RNA, 23 nt, Homo sapiens
ggccaggcugaggcccugacgug

SEQ ID NO: 2960 - RNA, 23 nt, Homo sapiens
gccaggcugaggcccugacgugg

SEQ ID NO: 2961 - RNA, 23 nt, Homo sapiens
ccaggcugaggcccugacgugga

SEQ ID NO: 2962 - RNA, 23 nt, Homo sapiens
caggcugaggcccugacguggau

SEQ ID NO: 2963 - RNA, 23 nt, Homo sapiens
aggcugaggcccugacguggaug

SEQ ID NO: 2964 - RNA, 23 nt, Homo sapiens
ggcugaggcccugacguggaugg

SEQ ID NO: 2965 - RNA, 23 nt, Homo sapiens
gcugaggcccugacguggauggg

SEQ ID NO: 2966 - RNA, 23 nt, Homo sapiens
cugaggcccugacguggaugggc

SEQ ID NO: 2967 - RNA, 23 nt, Homo sapiens
ugaggcccugacguggaugggca

SEQ ID NO: 2968 - RNA, 23 nt, Homo sapiens
gaggcccugacguggaugggcaa

SEQ ID NO: 2969 - RNA, 23 nt, Homo sapiens
aggcccugacguggaugggcaaa

SEQ ID NO: 2970 - RNA, 23 nt, Homo sapiens
ggcccugacguggaugggcaaac

SEQ ID NO: 2971 - RNA, 23 nt, Homo sapiens
gcccugacguggaugggcaaacu

SEQ ID NO: 2972 - RNA, 23 nt, Homo sapiens
cccugacguggaugggcaaacug

SEQ ID NO: 2973 - RNA, 23 nt, Homo sapiens
ccugacguggaugggcaaacugc

SEQ ID NO: 2974 - RNA, 23 nt, Homo sapiens
cugacguggaugggcaaacugca

SEQ ID NO: 2975 - RNA, 23 nt, Homo sapiens
ugacguggaugggcaaacugcag

SEQ ID NO: 2976 - RNA, 23 nt, Homo sapiens
gacguggaugggcaaacugcagg

SEQ ID NO: 2977 - RNA, 23 nt, Homo sapiens
acguggaugggcaaacugcaggc

SEQ ID NO: 2978 - RNA, 23 nt, Homo sapiens
cguggaugggcaaacugcaggcc

SEQ ID NO: 2979 - RNA, 23 nt, Homo sapiens
guggaugggcaaacugcaggccu

SEQ ID NO: 2980 - RNA, 23 nt, Homo sapiens
uggaugggcaaacugcaggccug

SEQ ID NO: 2981 - RNA, 23 nt, Homo sapiens
ggaugggcaaacugcaggccugg

SEQ ID NO: 2982 - RNA, 23 nt, Homo sapiens
gaugggcaaacugcaggccuggg

SEQ ID NO: 2983 - RNA, 23 nt, Homo sapiens
augggcaaacugcaggccuggga

SEQ ID NO: 2984 - RNA, 23 nt, Homo sapiens
ugggcaaacugcaggccugggaa

SEQ ID NO: 2985 - RNA, 23 nt, Homo sapiens
gggcaaacugcaggccugggaag

SEQ ID NO: 2986 - RNA, 23 nt, Homo sapiens
ggcaaacugcaggccugggaagg

SEQ ID NO: 2987 - RNA, 23 nt, Homo sapiens
gcaaacugcaggccugggaaggc

SEQ ID NO: 2988 - RNA, 23 nt, Homo sapiens
caaacugcaggccugggaaggca

SEQ ID NO: 2989 - RNA, 23 nt, Homo sapiens
aaacugcaggccugggaaggcag

SEQ ID NO: 2990 - RNA, 23 nt, Homo sapiens
aacugcaggccugggaaggcagc

SEQ ID NO: 2991 - RNA, 23 nt, Homo sapiens
acugcaggccugggaaggcagca

SEQ ID NO: 2992 - RNA, 23 nt, Homo sapiens
cugcaggccugggaaggcagcaa

SEQ ID NO: 2993 - RNA, 23 nt, Homo sapiens
ugcaggccugggaaggcagcaag

SEQ ID NO: 2994 - RNA, 23 nt, Homo sapiens
gcaggccugggaaggcagcaagc

SEQ ID NO: 2995 - RNA, 23 nt, Homo sapiens
caggccugggaaggcagcaagcc

SEQ ID NO: 2996 - RNA, 23 nt, Homo sapiens
aggccugggaaggcagcaagccg

SEQ ID NO: 2997 - RNA, 23 nt, Homo sapiens
ggccugggaaggcagcaagccgg

SEQ ID NO: 2998 - RNA, 23 nt, Homo sapiens
gccugggaaggcagcaagccggg

SEQ ID NO: 2999 - RNA, 23 nt, Homo sapiens
ccugggaaggcagcaagccgggc

SEQ ID NO: 3000 - RNA, 23 nt, Homo sapiens
cugggaaggcagcaagccgggcc

SEQ ID NO: 3001 - RNA, 23 nt, Homo sapiens
ugggaaggcagcaagccgggccg

SEQ ID NO: 3002 - RNA, 23 nt, Homo sapiens
gggaaggcagcaagccgggccgu

SEQ ID NO: 3003 - RNA, 23 nt, Homo sapiens
ggaaggcagcaagccgggccguc

SEQ ID NO: 3004 - RNA, 23 nt, Homo sapiens
gaaggcagcaagccgggccgucc

SEQ ID NO: 3005 - RNA, 23 nt, Homo sapiens
aaggcagcaagccgggccguccg

SEQ ID NO: 3006 - RNA, 23 nt, Homo sapiens
aggcagcaagccgggccguccgu

SEQ ID NO: 3007 - RNA, 23 nt, Homo sapiens
ggcagcaagccgggccguccgug

SEQ ID NO: 3008 - RNA, 23 nt, Homo sapiens
gcagcaagccgggccguccgugu

SEQ ID NO: 3009 - RNA, 23 nt, Homo sapiens
cagcaagccgggccguccguguu

SEQ ID NO: 3010 - RNA, 23 nt, Homo sapiens
agcaagccgggccguccguguuc

SEQ ID NO: 3011 - RNA, 23 nt, Homo sapiens
gcaagccgggccguccguguucc

SEQ ID NO: 3012 - RNA, 23 nt, Homo sapiens
caagccgggccguccguguucca

SEQ ID NO: 3013 - RNA, 23 nt, Homo sapiens
aagccgggccguccguguuccau

SEQ ID NO: 3014 - RNA, 23 nt, Homo sapiens
agccgggccguccguguuccauc

SEQ ID NO: 3015 - RNA, 23 nt, Homo sapiens
gccgggccguccguguuccaucc

SEQ ID NO: 3016 - RNA, 23 nt, Homo sapiens
ccgggccguccguguuccauccu

SEQ ID NO: 3017 - RNA, 23 nt, Homo sapiens
cgggccguccguguuccauccuc

SEQ ID NO: 3018 - RNA, 23 nt, Homo sapiens
gggccguccguguuccauccucc

SEQ ID NO: 3019 - RNA, 23 nt, Homo sapiens
ggccguccguguuccauccucca

SEQ ID NO: 3020 - RNA, 23 nt, Homo sapiens
gccguccguguuccauccuccac

SEQ ID NO: 3021 - RNA, 23 nt, Homo sapiens
ccguccguguuccauccuccacg

SEQ ID NO: 3022 - RNA, 23 nt, Homo sapiens
cguccguguuccauccuccacgc

SEQ ID NO: 3023 - RNA, 23 nt, Homo sapiens
guccguguuccauccuccacgca

SEQ ID NO: 3024 - RNA, 23 nt, Homo sapiens
uccguguuccauccuccacgcac

SEQ ID NO: 3025 - RNA, 23 nt, Homo sapiens
ccguguuccauccuccacgcacc

SEQ ID NO: 3026 - RNA, 23 nt, Homo sapiens
cguguuccauccuccacgcaccc

SEQ ID NO: 3027 - RNA, 23 nt, Homo sapiens
guguuccauccuccacgcacccc

SEQ ID NO: 3028 - RNA, 23 nt, Homo sapiens
uguuccauccuccacgcaccccc

SEQ ID NO: 3029 - RNA, 23 nt, Homo sapiens
guuccauccuccacgcaccccca

SEQ ID NO: 3030 - RNA, 23 nt, Homo sapiens
uuccauccuccacgcacccccac

SEQ ID NO: 3031 - RNA, 23 nt, Homo sapiens
uccauccuccacgcacccccacc

SEQ ID NO: 3032 - RNA, 23 nt, Homo sapiens
ccauccuccacgcacccccaccu

SEQ ID NO: 3033 - RNA, 23 nt, Homo sapiens
cauccuccacgcacccccaccua

SEQ ID NO: 3034 - RNA, 23 nt, Homo sapiens
auccuccacgcacccccaccuau

SEQ ID NO: 3035 - RNA, 23 nt, Homo sapiens
uccuccacgcacccccaccuauc

SEQ ID NO: 3036 - RNA, 23 nt, Homo sapiens
ccuccacgcacccccaccuaucg

SEQ ID NO: 3037 - RNA, 23 nt, Homo sapiens
cuccacgcacccccaccuaucgu

SEQ ID NO: 3038 - RNA, 23 nt, Homo sapiens
uccacgcacccccaccuaucguu

SEQ ID NO: 3039 - RNA, 23 nt, Homo sapiens
ccacgcacccccaccuaucguug

SEQ ID NO: 3040 - RNA, 23 nt, Homo sapiens
cacgcacccccaccuaucguugg

SEQ ID NO: 3041 - RNA, 23 nt, Homo sapiens
acgcacccccaccuaucguuggu

SEQ ID NO: 3042 - RNA, 23 nt, Homo sapiens
cgcacccccaccuaucguugguu

SEQ ID NO: 3043 - RNA, 23 nt, Homo sapiens
gcacccccaccuaucguugguuc

SEQ ID NO: 3044 - RNA, 23 nt, Homo sapiens
cacccccaccuaucguugguucg

SEQ ID NO: 3045 - RNA, 23 nt, Homo sapiens
acccccaccuaucguugguucgc

SEQ ID NO: 3046 - RNA, 23 nt, Homo sapiens
cccccaccuaucguugguucgca

SEQ ID NO: 3047 - RNA, 23 nt, Homo sapiens
ccccaccuaucguugguucgcaa

SEQ ID NO: 3048 - RNA, 23 nt, Homo sapiens
cccaccuaucguugguucgcaaa

SEQ ID NO: 3049 - RNA, 23 nt, Homo sapiens
ccaccuaucguugguucgcaaag

SEQ ID NO: 3050 - RNA, 23 nt, Homo sapiens
caccuaucguugguucgcaaagu

SEQ ID NO: 3051 - RNA, 23 nt, Homo sapiens
accuaucguugguucgcaaagug

SEQ ID NO: 3052 - RNA, 23 nt, Homo sapiens
ccuaucguugguucgcaaagugc

SEQ ID NO: 3053 - RNA, 23 nt, Homo sapiens
cuaucguugguucgcaaagugca

SEQ ID NO: 3054 - RNA, 23 nt, Homo sapiens
uaucguugguucgcaaagugcaa

SEQ ID NO: 3055 - RNA, 23 nt, Homo sapiens
aucguugguucgcaaagugcaaa

SEQ ID NO: 3056 - RNA, 23 nt, Homo sapiens
ucguugguucgcaaagugcaaag

SEQ ID NO: 3057 - RNA, 23 nt, Homo sapiens
cguugguucgcaaagugcaaagc

SEQ ID NO: 3058 - RNA, 23 nt, Homo sapiens
guugguucgcaaagugcaaagcu

SEQ ID NO: 3059 - RNA, 23 nt, Homo sapiens
uugguucgcaaagugcaaagcuu

SEQ ID NO: 3060 - RNA, 23 nt, Homo sapiens
ugguucgcaaagugcaaagcuuu

SEQ ID NO: 3061 - RNA, 23 nt, Homo sapiens
gguucgcaaagugcaaagcuuuc

SEQ ID NO: 3062 - RNA, 23 nt, Homo sapiens
guucgcaaagugcaaagcuuucu

SEQ ID NO: 3063 - RNA, 23 nt, Homo sapiens
uucgcaaagugcaaagcuuucuu

SEQ ID NO: 3064 - RNA, 23 nt, Homo sapiens
ucgcaaagugcaaagcuuucuug

SEQ ID NO: 3065 - RNA, 23 nt, Homo sapiens
cgcaaagugcaaagcuuucuugu

SEQ ID NO: 3066 - RNA, 23 nt, Homo sapiens
gcaaagugcaaagcuuucuugug

SEQ ID NO: 3067 - RNA, 23 nt, Homo sapiens
caaagugcaaagcuuucuugugc

SEQ ID NO: 3068 - RNA, 23 nt, Homo sapiens
aaagugcaaagcuuucuugugca

SEQ ID NO: 3069 - RNA, 23 nt, Homo sapiens
aagugcaaagcuuucuugugcau

SEQ ID NO: 3070 - RNA, 23 nt, Homo sapiens
agugcaaagcuuucuugugcaug

SEQ ID NO: 3071 - RNA, 23 nt, Homo sapiens
gugcaaagcuuucuugugcauga

SEQ ID NO: 3072 - RNA, 23 nt, Homo sapiens
ugcaaagcuuucuugugcaugac

SEQ ID NO: 3073 - RNA, 23 nt, Homo sapiens
gcaaagcuuucuugugcaugacg

SEQ ID NO: 3074 - RNA, 23 nt, Homo sapiens
caaagcuuucuugugcaugacgc

SEQ ID NO: 3075 - RNA, 23 nt, Homo sapiens
aaagcuuucuugugcaugacgcc

SEQ ID NO: 3076 - RNA, 23 nt, Homo sapiens
aagcuuucuugugcaugacgccc

SEQ ID NO: 3077 - RNA, 23 nt, Homo sapiens
agcuuucuugugcaugacgcccu

SEQ ID NO: 3078 - RNA, 23 nt, Homo sapiens
gcuuucuugugcaugacgcccug

SEQ ID NO: 3079 - RNA, 23 nt, Homo sapiens
cuuucuugugcaugacgcccugc

SEQ ID NO: 3080 - RNA, 23 nt, Homo sapiens
uuucuugugcaugacgcccugcu

SEQ ID NO: 3081 - RNA, 23 nt, Homo sapiens
uucuugugcaugacgcccugcuc

SEQ ID NO: 3082 - RNA, 23 nt, Homo sapiens
ucuugugcaugacgcccugcucu

SEQ ID NO: 3083 - RNA, 23 nt, Homo sapiens
cuugugcaugacgcccugcucug

SEQ ID NO: 3084 - RNA, 23 nt, Homo sapiens
uugugcaugacgcccugcucugg

SEQ ID NO: 3085 - RNA, 23 nt, Homo sapiens
ugugcaugacgcccugcucuggg

SEQ ID NO: 3086 - RNA, 23 nt, Homo sapiens
gugcaugacgcccugcucugggg

SEQ ID NO: 3087 - RNA, 23 nt, Homo sapiens
ugcaugacgcccugcucugggga

SEQ ID NO: 3088 - RNA, 23 nt, Homo sapiens
gcaugacgcccugcucuggggag

SEQ ID NO: 3089 - RNA, 23 nt, Homo sapiens
caugacgcccugcucuggggagc

SEQ ID NO: 3090 - RNA, 23 nt, Homo sapiens
augacgcccugcucuggggagcg

SEQ ID NO: 3091 - RNA, 23 nt, Homo sapiens
ugacgcccugcucuggggagcgu

SEQ ID NO: 3092 - RNA, 23 nt, Homo sapiens
gacgcccugcucuggggagcguc

SEQ ID NO: 3093 - RNA, 23 nt, Homo sapiens
acgcccugcucuggggagcgucu

SEQ ID NO: 3094 - RNA, 23 nt, Homo sapiens
cgcccugcucuggggagcgucug

SEQ ID NO: 3095 - RNA, 23 nt, Homo sapiens
gcccugcucuggggagcgucugg

SEQ ID NO: 3096 - RNA, 23 nt, Homo sapiens
cccugcucuggggagcgucuggc

SEQ ID NO: 3097 - RNA, 23 nt, Homo sapiens
ccugcucuggggagcgucuggcg

SEQ ID NO: 3098 - RNA, 23 nt, Homo sapiens
cugcucuggggagcgucuggcgc

SEQ ID NO: 3099 - RNA, 23 nt, Homo sapiens
ugcucuggggagcgucuggcgcg

SEQ ID NO: 3100 - RNA, 23 nt, Homo sapiens
gcucuggggagcgucuggcgcga

SEQ ID NO: 3101 - RNA, 23 nt, Homo sapiens
cucuggggagcgucuggcgcgau

SEQ ID NO: 3102 - RNA, 23 nt, Homo sapiens
ucuggggagcgucuggcgcgauc

SEQ ID NO: 3103 - RNA, 23 nt, Homo sapiens
cuggggagcgucuggcgcgaucu

SEQ ID NO: 3104 - RNA, 23 nt, Homo sapiens
uggggagcgucuggcgcgaucuc

SEQ ID NO: 3105 - RNA, 23 nt, Homo sapiens
ggggagcgucuggcgcgaucucu

SEQ ID NO: 3106 - RNA, 23 nt, Homo sapiens
gggagcgucuggcgcgaucucug

SEQ ID NO: 3107 - RNA, 23 nt, Homo sapiens
ggagcgucuggcgcgaucucugc

SEQ ID NO: 3108 - RNA, 23 nt, Homo sapiens
gagcgucuggcgcgaucucugcc

SEQ ID NO: 3109 - RNA, 23 nt, Homo sapiens
agcgucuggcgcgaucucugccu

SEQ ID NO: 3110 - RNA, 23 nt, Homo sapiens
gcgucuggcgcgaucucugccug

SEQ ID NO: 3111 - RNA, 23 nt, Homo sapiens
cgucuggcgcgaucucugccugc

SEQ ID NO: 3112 - RNA, 23 nt, Homo sapiens
gucuggcgcgaucucugccugcu

SEQ ID NO: 3113 - RNA, 23 nt, Homo sapiens
ucuggcgcgaucucugccugcuu

SEQ ID NO: 3114 - RNA, 23 nt, Homo sapiens
cuggcgcgaucucugccugcuua

SEQ ID NO: 3115 - RNA, 23 nt, Homo sapiens
uggcgcgaucucugccugcuuac

SEQ ID NO: 3116 - RNA, 23 nt, Homo sapiens
ggcgcgaucucugccugcuuacu

SEQ ID NO: 3117 - RNA, 23 nt, Homo sapiens
gcgcgaucucugccugcuuacuc

SEQ ID NO: 3118 - RNA, 23 nt, Homo sapiens
cgcgaucucugccugcuuacucg

SEQ ID NO: 3119 - RNA, 23 nt, Homo sapiens
gcgaucucugccugcuuacucgg

SEQ ID NO: 3120 - RNA, 23 nt, Homo sapiens
cgaucucugccugcuuacucggg

SEQ ID NO: 3121 - RNA, 23 nt, Homo sapiens
gaucucugccugcuuacucggga

SEQ ID NO: 3122 - RNA, 23 nt, Homo sapiens
aucucugccugcuuacucgggaa

SEQ ID NO: 3123 - RNA, 23 nt, Homo sapiens
ucucugccugcuuacucgggaaa

SEQ ID NO: 3124 - RNA, 23 nt, Homo sapiens
cucugccugcuuacucgggaaau

SEQ ID NO: 3125 - RNA, 23 nt, Homo sapiens
ucugccugcuuacucgggaaauu

SEQ ID NO: 3126 - RNA, 23 nt, Homo sapiens
cugccugcuuacucgggaaauuu

SEQ ID NO: 3127 - RNA, 23 nt, Homo sapiens
ugccugcuuacucgggaaauuug

SEQ ID NO: 3128 - RNA, 23 nt, Homo sapiens
gccugcuuacucgggaaauuugc

SEQ ID NO: 3129 - RNA, 23 nt, Homo sapiens
ccugcuuacucgggaaauuugcu

SEQ ID NO: 3130 - RNA, 23 nt, Homo sapiens
cugcuuacucgggaaauuugcuu

SEQ ID NO: 3131 - RNA, 23 nt, Homo sapiens
ugcuuacucgggaaauuugcuuu

SEQ ID NO: 3132 - RNA, 23 nt, Homo sapiens
gcuuacucgggaaauuugcuuuu

SEQ ID NO: 3133 - RNA, 23 nt, Homo sapiens
cuuacucgggaaauuugcuuuug

SEQ ID NO: 3134 - RNA, 23 nt, Homo sapiens
uuacucgggaaauuugcuuuugc

SEQ ID NO: 3135 - RNA, 23 nt, Homo sapiens
uacucgggaaauuugcuuuugcc

SEQ ID NO: 3136 - RNA, 23 nt, Homo sapiens
acucgggaaauuugcuuuugcca

SEQ ID NO: 3137 - RNA, 23 nt, Homo sapiens
cucgggaaauuugcuuuugccaa

SEQ ID NO: 3138 - RNA, 23 nt, Homo sapiens
ucgggaaauuugcuuuugccaaa

SEQ ID NO: 3139 - RNA, 23 nt, Homo sapiens
cgggaaauuugcuuuugccaaac

SEQ ID NO: 3140 - RNA, 23 nt, Homo sapiens
gggaaauuugcuuuugccaaacc

SEQ ID NO: 3141 - RNA, 23 nt, Homo sapiens
ggaaauuugcuuuugccaaaccc

SEQ ID NO: 3142 - RNA, 23 nt, Homo sapiens
gaaauuugcuuuugccaaacccg

SEQ ID NO: 3143 - RNA, 23 nt, Homo sapiens
aaauuugcuuuugccaaacccgc

SEQ ID NO: 3144 - RNA, 23 nt, Homo sapiens
aauuugcuuuugccaaacccgcu

SEQ ID NO: 3145 - RNA, 23 nt, Homo sapiens
auuugcuuuugccaaacccgcuu

SEQ ID NO: 3146 - RNA, 23 nt, Homo sapiens
uuugcuuuugccaaacccgcuuu

SEQ ID NO: 3147 - RNA, 23 nt, Homo sapiens
uugcuuuugccaaacccgcuuuu

SEQ ID NO: 3148 - RNA, 23 nt, Homo sapiens
ugcuuuugccaaacccgcuuuuu

SEQ ID NO: 3149 - RNA, 23 nt, Homo sapiens
gcuuuugccaaacccgcuuuuuc

SEQ ID NO: 3150 - RNA, 23 nt, Homo sapiens
cuuuugccaaacccgcuuuuucg

SEQ ID NO: 3151 - RNA, 23 nt, Homo sapiens
uuuugccaaacccgcuuuuucgg

SEQ ID NO: 3152 - RNA, 23 nt, Homo sapiens
uuugccaaacccgcuuuuucggg

SEQ ID NO: 3153 - RNA, 23 nt, Homo sapiens
uugccaaacccgcuuuuucgggg

SEQ ID NO: 3154 - RNA, 23 nt, Homo sapiens
ugccaaacccgcuuuuucgggga

SEQ ID NO: 3155 - RNA, 23 nt, Homo sapiens
gccaaacccgcuuuuucggggau

SEQ ID NO: 3156 - RNA, 23 nt, Homo sapiens
ccaaacccgcuuuuucggggauc

SEQ ID NO: 3157 - RNA, 23 nt, Homo sapiens
caaacccgcuuuuucggggaucc

SEQ ID NO: 3158 - RNA, 23 nt, Homo sapiens
aaacccgcuuuuucggggauccc

SEQ ID NO: 3159 - RNA, 23 nt, Homo sapiens
aacccgcuuuuucggggaucccg

SEQ ID NO: 3160 - RNA, 23 nt, Homo sapiens
acccgcuuuuucggggaucccgc

SEQ ID NO: 3161 - RNA, 23 nt, Homo sapiens
cccgcuuuuucggggaucccgcg

SEQ ID NO: 3162 - RNA, 23 nt, Homo sapiens
ccgcuuuuucggggaucccgcgc

SEQ ID NO: 3163 - RNA, 23 nt, Homo sapiens
cgcuuuuucggggaucccgcgcc

SEQ ID NO: 3164 - RNA, 23 nt, Homo sapiens
gcuuuuucggggaucccgcgccc

SEQ ID NO: 3165 - RNA, 23 nt, Homo sapiens
cuuuuucggggaucccgcgcccc

SEQ ID NO: 3166 - RNA, 23 nt, Homo sapiens
uuuuucggggaucccgcgccccc

SEQ ID NO: 3167 - RNA, 23 nt, Homo sapiens
uuuucggggaucccgcgcccccc

SEQ ID NO: 3168 - RNA, 23 nt, Homo sapiens
uuucggggaucccgcgccccccu

SEQ ID NO: 3169 - RNA, 23 nt, Homo sapiens
uucggggaucccgcgccccccuc

SEQ ID NO: 3170 - RNA, 23 nt, Homo sapiens
ucggggaucccgcgccccccucc

SEQ ID NO: 3171 - RNA, 23 nt, Homo sapiens
cggggaucccgcgccccccuccu

SEQ ID NO: 3172 - RNA, 23 nt, Homo sapiens
ggggaucccgcgccccccuccuc

SEQ ID NO: 3173 - RNA, 23 nt, Homo sapiens
gggaucccgcgccccccuccuca

SEQ ID NO: 3174 - RNA, 23 nt, Homo sapiens
ggaucccgcgccccccuccucac

SEQ ID NO: 3175 - RNA, 23 nt, Homo sapiens
gaucccgcgccccccuccucacu

SEQ ID NO: 3176 - RNA, 23 nt, Homo sapiens
aucccgcgccccccuccucacuu

SEQ ID NO: 3177 - RNA, 23 nt, Homo sapiens
ucccgcgccccccuccucacuug

SEQ ID NO: 3178 - RNA, 23 nt, Homo sapiens
cccgcgccccccuccucacuugc

SEQ ID NO: 3179 - RNA, 23 nt, Homo sapiens
ccgcgccccccuccucacuugcg

SEQ ID NO: 3180 - RNA, 23 nt, Homo sapiens
cgcgccccccuccucacuugcgc

SEQ ID NO: 3181 - RNA, 23 nt, Homo sapiens
gcgccccccuccucacuugcgcu

SEQ ID NO: 3182 - RNA, 23 nt, Homo sapiens
cgccccccuccucacuugcgcug

SEQ ID NO: 3183 - RNA, 23 nt, Homo sapiens
gccccccuccucacuugcgcugc

SEQ ID NO: 3184 - RNA, 23 nt, Homo sapiens
ccccccuccucacuugcgcugcu

SEQ ID NO: 3185 - RNA, 23 nt, Homo sapiens
cccccuccucacuugcgcugcuc

SEQ ID NO: 3186 - RNA, 23 nt, Homo sapiens
ccccuccucacuugcgcugcucu

SEQ ID NO: 3187 - RNA, 23 nt, Homo sapiens
cccuccucacuugcgcugcucuc

SEQ ID NO: 3188 - RNA, 23 nt, Homo sapiens
ccuccucacuugcgcugcucucg

SEQ ID NO: 3189 - RNA, 23 nt, Homo sapiens
cuccucacuugcgcugcucucgg

SEQ ID NO: 3190 - RNA, 23 nt, Homo sapiens
uccucacuugcgcugcucucgga

SEQ ID NO: 3191 - RNA, 23 nt, Homo sapiens
ccucacuugcgcugcucucggag

SEQ ID NO: 3192 - RNA, 23 nt, Homo sapiens
cucacuugcgcugcucucggagc

SEQ ID NO: 3193 - RNA, 23 nt, Homo sapiens
ucacuugcgcugcucucggagcc

SEQ ID NO: 3194 - RNA, 23 nt, Homo sapiens
cacuugcgcugcucucggagccc

SEQ ID NO: 3195 - RNA, 23 nt, Homo sapiens
acuugcgcugcucucggagcccc

SEQ ID NO: 3196 - RNA, 23 nt, Homo sapiens
cuugcgcugcucucggagcccca

SEQ ID NO: 3197 - RNA, 23 nt, Homo sapiens
uugcgcugcucucggagccccag

SEQ ID NO: 3198 - RNA, 23 nt, Homo sapiens
ugcgcugcucucggagccccagc

SEQ ID NO: 3199 - RNA, 23 nt, Homo sapiens
gcgcugcucucggagccccagcc

SEQ ID NO: 3200 - RNA, 23 nt, Homo sapiens
cgcugcucucggagccccagccg

SEQ ID NO: 3201 - RNA, 23 nt, Homo sapiens
gcugcucucggagccccagccgg

SEQ ID NO: 3202 - RNA, 23 nt, Homo sapiens
cugcucucggagccccagccggc

SEQ ID NO: 3203 - RNA, 23 nt, Homo sapiens
ugcucucggagccccagccggcu

SEQ ID NO: 3204 - RNA, 23 nt, Homo sapiens
gcucucggagccccagccggcuc

SEQ ID NO: 3205 - RNA, 23 nt, Homo sapiens
cucucggagccccagccggcucc

SEQ ID NO: 3206 - RNA, 23 nt, Homo sapiens
ucucggagccccagccggcuccg

SEQ ID NO: 3207 - RNA, 23 nt, Homo sapiens
cucggagccccagccggcuccgc

SEQ ID NO: 3208 - RNA, 23 nt, Homo sapiens
ucggagccccagccggcuccgcc

SEQ ID NO: 3209 - RNA, 23 nt, Homo sapiens
cggagccccagccggcuccgccc

SEQ ID NO: 3210 - RNA, 23 nt, Homo sapiens
ggagccccagccggcuccgcccg

SEQ ID NO: 3211 - RNA, 23 nt, Homo sapiens
gagccccagccggcuccgcccgc

SEQ ID NO: 3212 - RNA, 23 nt, Homo sapiens
agccccagccggcuccgcccgcu

SEQ ID NO: 3213 - RNA, 23 nt, Homo sapiens
gccccagccggcuccgcccgcuu

SEQ ID NO: 3214 - RNA, 23 nt, Homo sapiens
ccccagccggcuccgcccgcuuc

SEQ ID NO: 3215 - RNA, 23 nt, Homo sapiens
cccagccggcuccgcccgcuucg

SEQ ID NO: 3216 - RNA, 23 nt, Homo sapiens
ccagccggcuccgcccgcuucgg

SEQ ID NO: 3217 - RNA, 23 nt, Homo sapiens
cagccggcuccgcccgcuucggc

SEQ ID NO: 3218 - RNA, 23 nt, Homo sapiens
agccggcuccgcccgcuucggcg

SEQ ID NO: 3219 - RNA, 23 nt, Homo sapiens
gccggcuccgcccgcuucggcgg

SEQ ID NO: 3220 - RNA, 23 nt, Homo sapiens
ccggcuccgcccgcuucggcggu

SEQ ID NO: 3221 - RNA, 23 nt, Homo sapiens
cggcuccgcccgcuucggcgguu

SEQ ID NO: 3222 - RNA, 23 nt, Homo sapiens
ggcuccgcccgcuucggcgguuu

SEQ ID NO: 3223 - RNA, 23 nt, Homo sapiens
gcuccgcccgcuucggcgguuug

SEQ ID NO: 3224 - RNA, 23 nt, Homo sapiens
cuccgcccgcuucggcgguuugg

SEQ ID NO: 3225 - RNA, 23 nt, Homo sapiens
uccgcccgcuucggcgguuugga

SEQ ID NO: 3226 - RNA, 23 nt, Homo sapiens
ccgcccgcuucggcgguuuggau

SEQ ID NO: 3227 - RNA, 23 nt, Homo sapiens
cgcccgcuucggcgguuuggaua

SEQ ID NO: 3228 - RNA, 23 nt, Homo sapiens
gcccgcuucggcgguuuggauau

SEQ ID NO: 3229 - RNA, 23 nt, Homo sapiens
cccgcuucggcgguuuggauauu

SEQ ID NO: 3230 - RNA, 23 nt, Homo sapiens
ccgcuucggcgguuuggauauuu

SEQ ID NO: 3231 - RNA, 23 nt, Homo sapiens
cgcuucggcgguuuggauauuua

SEQ ID NO: 3232 - RNA, 23 nt, Homo sapiens
gcuucggcgguuuggauauuuau

SEQ ID NO: 3233 - RNA, 23 nt, Homo sapiens
cuucggcgguuuggauauuuauu

SEQ ID NO: 3234 - RNA, 23 nt, Homo sapiens
uucggcgguuuggauauuuauug

SEQ ID NO: 3235 - RNA, 23 nt, Homo sapiens
ucggcgguuuggauauuuauuga

SEQ ID NO: 3236 - RNA, 23 nt, Homo sapiens
cggcgguuuggauauuuauugac

SEQ ID NO: 3237 - RNA, 23 nt, Homo sapiens
ggcgguuuggauauuuauugacc

SEQ ID NO: 3238 - RNA, 23 nt, Homo sapiens
gcgguuuggauauuuauugaccu

SEQ ID NO: 3239 - RNA, 23 nt, Homo sapiens
cgguuuggauauuuauugaccuc

SEQ ID NO: 3240 - RNA, 23 nt, Homo sapiens
gguuuggauauuuauugaccucg

SEQ ID NO: 3241 - RNA, 23 nt, Homo sapiens
guuuggauauuuauugaccucgu

SEQ ID NO: 3242 - RNA, 23 nt, Homo sapiens
uuuggauauuuauugaccucguc

SEQ ID NO: 3243 - RNA, 23 nt, Homo sapiens
uuggauauuuauugaccucgucc

SEQ ID NO: 3244 - RNA, 23 nt, Homo sapiens
uggauauuuauugaccucguccu

SEQ ID NO: 3245 - RNA, 23 nt, Homo sapiens
ggauauuuauugaccucguccuc

SEQ ID NO: 3246 - RNA, 23 nt, Homo sapiens
gauauuuauugaccucguccucc

SEQ ID NO: 3247 - RNA, 23 nt, Homo sapiens
auauuuauugaccucguccuccg

SEQ ID NO: 3248 - RNA, 23 nt, Homo sapiens
uauuuauugaccucguccuccga

SEQ ID NO: 3249 - RNA, 23 nt, Homo sapiens
auuuauugaccucguccuccgac

SEQ ID NO: 3250 - RNA, 23 nt, Homo sapiens
uuuauugaccucguccuccgacu

SEQ ID NO: 3251 - RNA, 23 nt, Homo sapiens
uuauugaccucguccuccgacuc

SEQ ID NO: 3252 - RNA, 23 nt, Homo sapiens
uauugaccucguccuccgacucg

SEQ ID NO: 3253 - RNA, 23 nt, Homo sapiens
auugaccucguccuccgacucgc

SEQ ID NO: 3254 - RNA, 23 nt, Homo sapiens
uugaccucguccuccgacucgcu

SEQ ID NO: 3255 - RNA, 23 nt, Homo sapiens
ugaccucguccuccgacucgcug

SEQ ID NO: 3256 - RNA, 23 nt, Homo sapiens
gaccucguccuccgacucgcuga

SEQ ID NO: 3257 - RNA, 23 nt, Homo sapiens
accucguccuccgacucgcugac

SEQ ID NO: 3258 - RNA, 23 nt, Homo sapiens
ccucguccuccgacucgcugaca

SEQ ID NO: 3259 - RNA, 23 nt, Homo sapiens
cucguccuccgacucgcugacag

SEQ ID NO: 3260 - RNA, 23 nt, Homo sapiens
ucguccuccgacucgcugacagg

SEQ ID NO: 3261 - RNA, 23 nt, Homo sapiens
cguccuccgacucgcugacaggc

SEQ ID NO: 3262 - RNA, 23 nt, Homo sapiens
guccuccgacucgcugacaggcu

SEQ ID NO: 3263 - RNA, 23 nt, Homo sapiens
uccuccgacucgcugacaggcua

SEQ ID NO: 3264 - RNA, 23 nt, Homo sapiens
ccuccgacucgcugacaggcuac

SEQ ID NO: 3265 - RNA, 23 nt, Homo sapiens
cuccgacucgcugacaggcuaca

SEQ ID NO: 3266 - RNA, 23 nt, Homo sapiens
uccgacucgcugacaggcuacag

SEQ ID NO: 3267 - RNA, 23 nt, Homo sapiens
ccgacucgcugacaggcuacagg

SEQ ID NO: 3268 - RNA, 23 nt, Homo sapiens
cgacucgcugacaggcuacagga

SEQ ID NO: 3269 - RNA, 23 nt, Homo sapiens
gacucgcugacaggcuacaggac

SEQ ID NO: 3270 - RNA, 23 nt, Homo sapiens
acucgcugacaggcuacaggacc

SEQ ID NO: 3271 - RNA, 23 nt, Homo sapiens
cucgcugacaggcuacaggaccc

SEQ ID NO: 3272 - RNA, 23 nt, Homo sapiens
ucgcugacaggcuacaggacccc

SEQ ID NO: 3273 - RNA, 23 nt, Homo sapiens
cgcugacaggcuacaggaccccc

SEQ ID NO: 3274 - RNA, 23 nt, Homo sapiens
gcugacaggcuacaggaccccca

SEQ ID NO: 3275 - RNA, 23 nt, Homo sapiens
cugacaggcuacaggacccccaa

SEQ ID NO: 3276 - RNA, 23 nt, Homo sapiens
ugacaggcuacaggacccccaac

SEQ ID NO: 3277 - RNA, 23 nt, Homo sapiens
gacaggcuacaggacccccaaca

SEQ ID NO: 3278 - RNA, 23 nt, Homo sapiens
acaggcuacaggacccccaacaa

SEQ ID NO: 3279 - RNA, 23 nt, Homo sapiens
caggcuacaggacccccaacaac

SEQ ID NO: 3280 - RNA, 23 nt, Homo sapiens
aggcuacaggacccccaacaacc

SEQ ID NO: 3281 - RNA, 23 nt, Homo sapiens
ggcuacaggacccccaacaaccc

SEQ ID NO: 3282 - RNA, 23 nt, Homo sapiens
gcuacaggacccccaacaacccc

SEQ ID NO: 3283 - RNA, 23 nt, Homo sapiens
cuacaggacccccaacaacccca

SEQ ID NO: 3284 - RNA, 23 nt, Homo sapiens
uacaggacccccaacaaccccaa

SEQ ID NO: 3285 - RNA, 23 nt, Homo sapiens
acaggacccccaacaaccccaau

SEQ ID NO: 3286 - RNA, 23 nt, Homo sapiens
caggacccccaacaaccccaauc

SEQ ID NO: 3287 - RNA, 23 nt, Homo sapiens
aggacccccaacaaccccaaucc

SEQ ID NO: 3288 - RNA, 23 nt, Homo sapiens
ggacccccaacaaccccaaucca

SEQ ID NO: 3289 - RNA, 23 nt, Homo sapiens
gacccccaacaaccccaauccac

SEQ ID NO: 3290 - RNA, 23 nt, Homo sapiens
acccccaacaaccccaauccacg

SEQ ID NO: 3291 - RNA, 23 nt, Homo sapiens
cccccaacaaccccaauccacgu

SEQ ID NO: 3292 - RNA, 23 nt, Homo sapiens
ccccaacaaccccaauccacguu

SEQ ID NO: 3293 - RNA, 23 nt, Homo sapiens
cccaacaaccccaauccacguuu

SEQ ID NO: 3294 - RNA, 23 nt, Homo sapiens
ccaacaaccccaauccacguuuu

SEQ ID NO: 3295 - RNA, 23 nt, Homo sapiens
caacaaccccaauccacguuuug

SEQ ID NO: 3296 - RNA, 23 nt, Homo sapiens
aacaaccccaauccacguuuugg

SEQ ID NO: 3297 - RNA, 23 nt, Homo sapiens
acaaccccaauccacguuuugga

SEQ ID NO: 3298 - RNA, 23 nt, Homo sapiens
caaccccaauccacguuuuggau

SEQ ID NO: 3299 - RNA, 23 nt, Homo sapiens
aaccccaauccacguuuuggaug

SEQ ID NO: 3300 - RNA, 23 nt, Homo sapiens
accccaauccacguuuuggaugc

SEQ ID NO: 3301 - RNA, 23 nt, Homo sapiens
ccccaauccacguuuuggaugca

SEQ ID NO: 3302 - RNA, 23 nt, Homo sapiens
cccaauccacguuuuggaugcac

SEQ ID NO: 3303 - RNA, 23 nt, Homo sapiens
ccaauccacguuuuggaugcacu

SEQ ID NO: 3304 - RNA, 23 nt, Homo sapiens
caauccacguuuuggaugcacug

SEQ ID NO: 3305 - RNA, 23 nt, Homo sapiens
aauccacguuuuggaugcacuga

SEQ ID NO: 3306 - RNA, 23 nt, Homo sapiens
auccacguuuuggaugcacugag

SEQ ID NO: 3307 - RNA, 23 nt, Homo sapiens
uccacguuuuggaugcacugaga

SEQ ID NO: 3308 - RNA, 23 nt, Homo sapiens
ccacguuuuggaugcacugagac

SEQ ID NO: 3309 - RNA, 23 nt, Homo sapiens
cacguuuuggaugcacugagacc

SEQ ID NO: 3310 - RNA, 23 nt, Homo sapiens
acguuuuggaugcacugagaccc

SEQ ID NO: 3311 - RNA, 23 nt, Homo sapiens
cguuuuggaugcacugagacccc

SEQ ID NO: 3312 - RNA, 23 nt, Homo sapiens
guuuuggaugcacugagaccccg

SEQ ID NO: 3313 - RNA, 23 nt, Homo sapiens
uuuuggaugcacugagaccccga

SEQ ID NO: 3314 - RNA, 23 nt, Homo sapiens
uuuggaugcacugagaccccgac

SEQ ID NO: 3315 - RNA, 23 nt, Homo sapiens
uuggaugcacugagaccccgaca

SEQ ID NO: 3316 - RNA, 23 nt, Homo sapiens
uggaugcacugagaccccgacau

SEQ ID NO: 3317 - RNA, 23 nt, Homo sapiens
ggaugcacugagaccccgacauu

SEQ ID NO: 3318 - RNA, 23 nt, Homo sapiens
gaugcacugagaccccgacauuc

SEQ ID NO: 3319 - RNA, 23 nt, Homo sapiens
augcacugagaccccgacauucc

SEQ ID NO: 3320 - RNA, 23 nt, Homo sapiens
ugcacugagaccccgacauuccu

SEQ ID NO: 3321 - RNA, 23 nt, Homo sapiens
gcacugagaccccgacauuccuc

SEQ ID NO: 3322 - RNA, 23 nt, Homo sapiens
cacugagaccccgacauuccucg

SEQ ID NO: 3323 - RNA, 23 nt, Homo sapiens
acugagaccccgacauuccucgg

SEQ ID NO: 3324 - RNA, 23 nt, Homo sapiens
cugagaccccgacauuccucggu

SEQ ID NO: 3325 - RNA, 23 nt, Homo sapiens
ugagaccccgacauuccucggua

SEQ ID NO: 3326 - RNA, 23 nt, Homo sapiens
gagaccccgacauuccucgguau

SEQ ID NO: 3327 - RNA, 23 nt, Homo sapiens
agaccccgacauuccucgguauu

SEQ ID NO: 3328 - RNA, 23 nt, Homo sapiens
gaccccgacauuccucgguauuu

SEQ ID NO: 3329 - RNA, 23 nt, Homo sapiens
accccgacauuccucgguauuua

SEQ ID NO: 3330 - RNA, 23 nt, Homo sapiens
ccccgacauuccucgguauuuau

SEQ ID NO: 3331 - RNA, 23 nt, Homo sapiens
cccgacauuccucgguauuuauu

SEQ ID NO: 3332 - RNA, 23 nt, Homo sapiens
ccgacauuccucgguauuuauug

SEQ ID NO: 3333 - RNA, 23 nt, Homo sapiens
cgacauuccucgguauuuauugu

SEQ ID NO: 3334 - RNA, 23 nt, Homo sapiens
gacauuccucgguauuuauuguc

SEQ ID NO: 3335 - RNA, 23 nt, Homo sapiens
acauuccucgguauuuauugucu

SEQ ID NO: 3336 - RNA, 23 nt, Homo sapiens
cauuccucgguauuuauugucug

SEQ ID NO: 3337 - RNA, 23 nt, Homo sapiens
auuccucgguauuuauugucugu

SEQ ID NO: 3338 - RNA, 23 nt, Homo sapiens
uuccucgguauuuauugucuguc

SEQ ID NO: 3339 - RNA, 23 nt, Homo sapiens
uccucgguauuuauugucugucc

SEQ ID NO: 3340 - RNA, 23 nt, Homo sapiens
ccucgguauuuauugucuguccc

SEQ ID NO: 3341 - RNA, 23 nt, Homo sapiens
cucgguauuuauugucugucccc

SEQ ID NO: 3342 - RNA, 23 nt, Homo sapiens
ucgguauuuauugucugucccca

SEQ ID NO: 3343 - RNA, 23 nt, Homo sapiens
cgguauuuauugucuguccccac

SEQ ID NO: 3344 - RNA, 23 nt, Homo sapiens
gguauuuauugucuguccccacc

SEQ ID NO: 3345 - RNA, 23 nt, Homo sapiens
guauuuauugucuguccccaccu

SEQ ID NO: 3346 - RNA, 23 nt, Homo sapiens
uauuuauugucuguccccaccua

SEQ ID NO: 3347 - RNA, 23 nt, Homo sapiens
auuuauugucuguccccaccuag

SEQ ID NO: 3348 - RNA, 23 nt, Homo sapiens
uuuauugucuguccccaccuagg

SEQ ID NO: 3349 - RNA, 23 nt, Homo sapiens
uuauugucuguccccaccuagga

SEQ ID NO: 3350 - RNA, 23 nt, Homo sapiens
uauugucuguccccaccuaggac

SEQ ID NO: 3351 - RNA, 23 nt, Homo sapiens
auugucuguccccaccuaggacc

SEQ ID NO: 3352 - RNA, 23 nt, Homo sapiens
uugucuguccccaccuaggaccc

SEQ ID NO: 3353 - RNA, 23 nt, Homo sapiens
ugucuguccccaccuaggacccc

SEQ ID NO: 3354 - RNA, 23 nt, Homo sapiens
gucuguccccaccuaggaccccc

SEQ ID NO: 3355 - RNA, 23 nt, Homo sapiens
ucuguccccaccuaggaccccca

SEQ ID NO: 3356 - RNA, 23 nt, Homo sapiens
cuguccccaccuaggacccccac

SEQ ID NO: 3357 - RNA, 23 nt, Homo sapiens
uguccccaccuaggacccccacc

SEQ ID NO: 3358 - RNA, 23 nt, Homo sapiens
guccccaccuaggacccccaccc

SEQ ID NO: 3359 - RNA, 23 nt, Homo sapiens
uccccaccuaggacccccacccc

SEQ ID NO: 3360 - RNA, 23 nt, Homo sapiens
ccccaccuaggacccccaccccc

SEQ ID NO: 3361 - RNA, 23 nt, Homo sapiens
cccaccuaggacccccacccccg

SEQ ID NO: 3362 - RNA, 23 nt, Homo sapiens
ccaccuaggacccccacccccga

SEQ ID NO: 3363 - RNA, 23 nt, Homo sapiens
caccuaggacccccacccccgac

SEQ ID NO: 3364 - RNA, 23 nt, Homo sapiens
accuaggacccccacccccgacc

SEQ ID NO: 3365 - RNA, 23 nt, Homo sapiens
ccuaggacccccacccccgaccc

SEQ ID NO: 3366 - RNA, 23 nt, Homo sapiens
cuaggacccccacccccgacccu

SEQ ID NO: 3367 - RNA, 23 nt, Homo sapiens
uaggacccccacccccgacccuc

SEQ ID NO: 3368 - RNA, 23 nt, Homo sapiens
aggacccccacccccgacccucg

SEQ ID NO: 3369 - RNA, 23 nt, Homo sapiens
ggacccccacccccgacccucgc

SEQ ID NO: 3370 - RNA, 23 nt, Homo sapiens
gacccccacccccgacccucgcg

SEQ ID NO: 3371 - RNA, 23 nt, Homo sapiens
acccccacccccgacccucgcga

SEQ ID NO: 3372 - RNA, 23 nt, Homo sapiens
cccccacccccgacccucgcgaa

SEQ ID NO: 3373 - RNA, 23 nt, Homo sapiens
ccccacccccgacccucgcgaau

SEQ ID NO: 3374 - RNA, 23 nt, Homo sapiens
cccacccccgacccucgcgaaua

SEQ ID NO: 3375 - RNA, 23 nt, Homo sapiens
ccacccccgacccucgcgaauaa

SEQ ID NO: 3376 - RNA, 23 nt, Homo sapiens
cacccccgacccucgcgaauaaa

SEQ ID NO: 3377 - RNA, 23 nt, Homo sapiens
acccccgacccucgcgaauaaaa

SEQ ID NO: 3378 - RNA, 23 nt, Homo sapiens
cccccgacccucgcgaauaaaag

SEQ ID NO: 3379 - RNA, 23 nt, Homo sapiens
ccccgacccucgcgaauaaaagg

SEQ ID NO: 3380 - RNA, 23 nt, Homo sapiens
cccgacccucgcgaauaaaaggc

SEQ ID NO: 3381 - RNA, 23 nt, Homo sapiens
ccgacccucgcgaauaaaaggcc

SEQ ID NO: 3382 - RNA, 23 nt, Homo sapiens
cgacccucgcgaauaaaaggccc

SEQ ID NO: 3383 - RNA, 23 nt, Homo sapiens
gacccucgcgaauaaaaggcccu

SEQ ID NO: 3384 - RNA, 23 nt, Homo sapiens
acccucgcgaauaaaaggcccuc

SEQ ID NO: 3385 - RNA, 23 nt, Homo sapiens
cccucgcgaauaaaaggcccucc

SEQ ID NO: 3386 - RNA, 23 nt, Homo sapiens
ccucgcgaauaaaaggcccucca

SEQ ID NO: 3387 - RNA, 23 nt, Homo sapiens
cucgcgaauaaaaggcccuccau

SEQ ID NO: 3388 - RNA, 23 nt, Homo sapiens
ucgcgaauaaaaggcccuccauc

SEQ ID NO: 3389 - RNA, 23 nt, Homo sapiens
cgcgaauaaaaggcccuccaucu

SEQ ID NO: 3390 - RNA, 23 nt, Homo sapiens
gcgaauaaaaggcccuccaucug

SEQ ID NO: 3391 - RNA, 23 nt, Homo sapiens
cgaauaaaaggcccuccaucugc

SEQ ID NO: 3392 - RNA, 23 nt, Homo sapiens
gaauaaaaggcccuccaucugcc

SEQ ID NO: 3393 - RNA, 23 nt, Homo sapiens
aauaaaaggcccuccaucugccc

SEQ ID NO: 3394 - RNA, 23 nt, Homo sapiens
auaaaaggcccuccaucugccca

SEQ ID NO: 3395 - RNA, 23 nt, Homo sapiens
uaaaaggcccuccaucugcccaa

SEQ ID NO: 3396 - RNA, 23 nt, Homo sapiens
aaaaggcccuccaucugcccaaa

SEQ ID NO: 3397 - RNA, 23 nt, Homo sapiens
aaaggcccuccaucugcccaaag

SEQ ID NO: 3398 - RNA, 23 nt, Homo sapiens
aaggcccuccaucugcccaaagc

SEQ ID NO: 3399 - RNA, 23 nt, Homo sapiens
aggcccuccaucugcccaaagcu

SEQ ID NO: 3400 - RNA, 23 nt, Homo sapiens
ggcccuccaucugcccaaagcuc

SEQ ID NO: 3401 - RNA, 23 nt, Homo sapiens
gcccuccaucugcccaaagcucu

SEQ ID NO: 3402 - RNA, 23 nt, Homo sapiens
cccuccaucugcccaaagcucug

SEQ ID NO: 3403 - RNA, 23 nt, Homo sapiens
ccuccaucugcccaaagcucugg

SEQ ID NO: 3404 - RNA, 23 nt, Homo sapiens
cuccaucugcccaaagcucugga

SEQ ID NO: 3405 - RNA, 23 nt, Homo sapiens
  modified_base (23)..(23): a, c, u, g, unknown or other
uccaucugcccaaagcucuggan

SEQ ID NO: 3406 - RNA, 23 nt, Homo sapiens
  modified_base (22)..(23): a, c, u, g, unknown or other
ccaucugcccaaagcucuggann

SEQ ID NO: 3407 - RNA, 19 nt, Artificial Sequence
  Description of Artificial Sequence: Synthetic oligonucleotide
aggggggcuggaccaaggg

SEQ ID NO: 3408 - RNA, 19 nt, Artificial Sequence
  Description of Artificial Sequence: Synthetic oligonucleotide
ggggggcuggaccaagggg

SEQ ID NO: 3409 - RNA, 19 nt, Artificial Sequence
  Description of Artificial Sequence: Synthetic oligonucleotide
gggggcuggaccaaggggu

SEQ ID NO: 3410 - RNA, 19 nt, Artificial Sequence
  Description of Artificial Sequence: Synthetic oligonucleotide
ggggcuggaccaaggggug

SEQ ID NO: 3411 - RNA, 19 nt, Artificial Sequence
  Description of Artificial Sequence: Synthetic oligonucleotide
gggcuggaccaaggggugg

SEQ ID NO: 3412 - RNA, 19 nt, Artificial Sequence
  Description of Artificial Sequence: Synthetic oligonucleotide
ggcuggaccaagggguggg

SEQ ID NO: 3413 - RNA, 19 nt, Artificial Sequence
  Description of Artificial Sequence: Synthetic oligonucleotide
gcuggaccaaggggugggg

SEQ ID NO: 3414 - RNA, 19 nt, Artificial Sequence
  Description of Artificial Sequence: Synthetic oligonucleotide
cuggaccaaggggugggga

SEQ ID NO: 3415 - RNA, 19 nt, Artificial Sequence
  Description of Artificial Sequence: Synthetic oligonucleotide
uggaccaagggguggggag

SEQ ID NO: 3416 - RNA, 19 nt, Artificial Sequence
  Description of Artificial Sequence: Synthetic oligonucleotide
ggaccaagggguggggaga

SEQ ID NO: 3417 - RNA, 19 nt, Artificial Sequence
  Description of Artificial Sequence: Synthetic oligonucleotide
gaccaagggguggggagaa

SEQ ID NO: 3418 - RNA, 19 nt, Artificial Sequence
  Description of Artificial Sequence: Synthetic oligonucleotide
accaagggguggggagaag

SEQ ID NO: 3419 - RNA, 19 nt, Artificial Sequence
  Description of Artificial Sequence: Synthetic oligonucleotide
ccaagggguggggagaagg

SEQ ID NO: 3420 - RNA, 19 nt, Artificial Sequence
  Description of Artificial Sequence: Synthetic oligonucleotide
caagggguggggagaaggg

SEQ ID NO: 3421 - RNA, 19 nt, Artificial Sequence
  Description of Artificial Sequence: Synthetic oligonucleotide
aagggguggggagaagggg

SEQ ID NO: 3422 - RNA, 19 nt, Artificial Sequence
  Description of Artificial Sequence: Synthetic oligonucleotide
agggguggggagaagggga

SEQ ID NO: 3423 - RNA, 19 nt, Artificial Sequence
  Description of Artificial Sequence: Synthetic oligonucleotide
gggguggggagaaggggag

SEQ ID NO: 3424 - RNA, 19 nt, Artificial Sequence
  Description of Artificial Sequence: Synthetic oligonucleotide
ggguggggagaaggggagg

SEQ ID NO: 3425 - RNA, 19 nt, Artificial Sequence
  Description of Artificial Sequence: Synthetic oligonucleotide
gguggggagaaggggagga

SEQ ID NO: 3426 - RNA, 19 nt, Artificial Sequence
  Description of Artificial Sequence: Synthetic oligonucleotide
guggggagaaggggaggag

SEQ ID NO: 3427 - RNA, 19 nt, Artificial Sequence
  Description of Artificial Sequence: Synthetic oligonucleotide
uggggagaaggggaggagg

SEQ ID NO: 3428 - RNA, 19 nt, Artificial Sequence
  Description of Artificial Sequence: Synthetic oligonucleotide
ggggagaaggggaggaggc

SEQ ID NO: 3429 - RNA, 19 nt, Artificial Sequence
  Description of Artificial Sequence: Synthetic oligonucleotide
gggagaaggggaggaggcc

SEQ ID NO: 3430 - RNA, 19 nt, Artificial Sequence
  Description of Artificial Sequence: Synthetic oligonucleotide
ggagaaggggaggaggccu

SEQ ID NO: 3431 - RNA, 19 nt, Artificial Sequence
  Description of Artificial Sequence: Synthetic oligonucleotide
gagaaggggaggaggccuc

SEQ ID NO: 3432 - RNA, 19 nt, Artificial Sequence
  Description of Artificial Sequence: Synthetic oligonucleotide
agaaggggaggaggccucg

SEQ ID NO: 3433 - RNA, 19 nt, Artificial Sequence
  Description of Artificial Sequence: Synthetic oligonucleotide
gaaggggaggaggccucgg

SEQ ID NO: 3434 - RNA, 19 nt, Artificial Sequence
  Description of Artificial Sequence: Synthetic oligonucleotide
aaggggaggaggccucggc

SEQ ID NO: 3435 - RNA, 19 nt, Artificial Sequence
  Description of Artificial Sequence: Synthetic oligonucleotide
aggggaggaggccucggcc

SEQ ID NO: 3436 - RNA, 19 nt, Artificial Sequence
  Description of Artificial Sequence: Synthetic oligonucleotide
ggggaggaggccucggccg

SEQ ID NO: 3437 - RNA, 19 nt, Artificial Sequence
  Description of Artificial Sequence: Synthetic oligonucleotide
gggaggaggccucggccgg

SEQ ID NO: 3438 - RNA, 19 nt, Artificial Sequence
  Description of Artificial Sequence: Synthetic oligonucleotide
ggaggaggccucggccggc

SEQ ID NO: 3439 - RNA, 19 nt, Artificial Sequence
  Description of Artificial Sequence: Synthetic oligonucleotide
gaggaggccucggccggcc

SEQ ID NO: 3440 - RNA, 19 nt, Artificial Sequence
  Description of Artificial Sequence: Synthetic oligonucleotide
aggaggccucggccggccg

SEQ ID NO: 3441 - RNA, 19 nt, Artificial Sequence
  Description of Artificial Sequence: Synthetic oligonucleotide
ggaggccucggccggccgc

SEQ ID NO: 3442 - RNA, 19 nt, Artificial Sequence
  Description of Artificial Sequence: Synthetic oligonucleotide
gaggccucggccggccgca

SEQ ID NO: 3443 - RNA, 19 nt, Artificial Sequence
  Description of Artificial Sequence: Synthetic oligonucleotide
aggccucggccggccgcag

SEQ ID NO: 3444 - RNA, 19 nt, Artificial Sequence
  Description of Artificial Sequence: Synthetic oligonucleotide
ggccucggccggccgcaga

SEQ ID NO: 3445 - RNA, 19 nt, Artificial Sequence
  Description of Artificial Sequence: Synthetic oligonucleotide
gccucggccggccgcagag

SEQ ID NO: 3446 - RNA, 19 nt, Artificial Sequence
  Description of Artificial Sequence: Synthetic oligonucleotide
ccucggccggccgcagaga

SEQ ID NO: 3447 - RNA, 19 nt, Artificial Sequence
  Description of Artificial Sequence: Synthetic oligonucleotide
cucggccggccgcagagag

SEQ ID NO: 3448 - RNA, 19 nt, Artificial Sequence
  Description of Artificial Sequence: Synthetic oligonucleotide
ucggccggccgcagagaga

SEQ ID NO: 3449 - RNA, 19 nt, Artificial Sequence
  Description of Artificial Sequence: Synthetic oligonucleotide
cggccggccgcagagagaa

SEQ ID NO: 3450 - RNA, 19 nt, Artificial Sequence
  Description of Artificial Sequence: Synthetic oligonucleotide
ggccggccgcagagagaag

SEQ ID NO: 3451 - RNA, 19 nt, Artificial Sequence
  Description of Artificial Sequence: Synthetic oligonucleotide
gccggccgcagagagaagu

SEQ ID NO: 3452 - RNA, 19 nt, Artificial Sequence
  Description of Artificial Sequence: Synthetic oligonucleotide
ccggccgcagagagaagug

SEQ ID NO: 3453 - RNA, 19 nt, Artificial Sequence
  Description of Artificial Sequence: Synthetic oligonucleotide
cggccgcagagagaagugg

SEQ ID NO: 3454 - RNA, 19 nt, Artificial Sequence
  Description of Artificial Sequence: Synthetic oligonucleotide
ggccgcagagagaaguggc

SEQ ID NO: 3455 - RNA, 19 nt, Artificial Sequence
  Description of Artificial Sequence: Synthetic oligonucleotide
gccgcagagagaaguggcc

SEQ ID NO: 3456 - RNA, 19 nt, Artificial Sequence
  Description of Artificial Sequence: Synthetic oligonucleotide
ccgcagagagaaguggcca

SEQ ID NO: 3457 - RNA, 19 nt, Artificial Sequence
  Description of Artificial Sequence: Synthetic oligonucleotide
cgcagagagaaguggccag

SEQ ID NO: 3458 - RNA, 19 nt, Artificial Sequence
  Description of Artificial Sequence: Synthetic oligonucleotide
gcagagagaaguggccaga

SEQ ID NO: 3459 - RNA, 19 nt, Artificial Sequence
  Description of Artificial Sequence: Synthetic oligonucleotide
cagagagaaguggccagag

SEQ ID NO: 3460 - RNA, 19 nt, Artificial Sequence
  Description of Artificial Sequence: Synthetic oligonucleotide
agagagaaguggccagaga

SEQ ID NO: 3461 - RNA, 19 nt, Artificial Sequence
  Description of Artificial Sequence: Synthetic oligonucleotide
gagagaaguggccagagag

SEQ ID NO: 3462 - RNA, 19 nt, Artificial Sequence
  Description of Artificial Sequence: Synthetic oligonucleotide
agagaaguggccagagagg

SEQ ID NO: 3463 - RNA, 19 nt, Artificial Sequence
  Description of Artificial Sequence: Synthetic oligonucleotide
gagaaguggccagagaggc

SEQ ID NO: 3464 - RNA, 19 nt, Artificial Sequence
  Description of Artificial Sequence: Synthetic oligonucleotide
agaaguggccagagaggcc

SEQ ID NO: 3465 - RNA, 19 nt, Artificial Sequence
  Description of Artificial Sequence: Synthetic oligonucleotide
gaaguggccagagaggccc

SEQ ID NO: 3466 - RNA, 19 nt, Artificial Sequence
  Description of Artificial Sequence: Synthetic oligonucleotide
aaguggccagagaggccca

SEQ ID NO: 3467 - RNA, 19 nt, Artificial Sequence
  Description of Artificial Sequence: Synthetic oligonucleotide
aguggccagagaggcccag

SEQ ID NO: 3468 - RNA, 19 nt, Artificial Sequence
  Description of Artificial Sequence: Synthetic oligonucleotide
guggccagagaggcccagg

SEQ ID NO: 3469 - RNA, 19 nt, Artificial Sequence
  Description of Artificial Sequence: Synthetic oligonucleotide
uggccagagaggcccaggg

SEQ ID NO: 3470 - RNA, 19 nt, Artificial Sequence
  Description of Artificial Sequence: Synthetic oligonucleotide
ggccagagaggcccagggg

SEQ ID NO: 3471 - RNA, 19 nt, Artificial Sequence
  Description of Artificial Sequence: Synthetic oligonucleotide
gccagagaggcccagggga

SEQ ID NO: 3472 - RNA, 19 nt, Artificial Sequence
  Description of Artificial Sequence: Synthetic oligonucleotide
ccagagaggcccaggggac

SEQ ID NO: 3473 - RNA, 19 nt, Artificial Sequence
  Description of Artificial Sequence: Synthetic oligonucleotide
cagagaggcccaggggaca

SEQ ID NO: 3474 - RNA, 19 nt, Artificial Sequence
  Description of Artificial Sequence: Synthetic oligonucleotide
agagaggcccaggggacag

SEQ ID NO: 3475 - RNA, 19 nt, Artificial Sequence
  Description of Artificial Sequence: Synthetic oligonucleotide
gagaggcccaggggacagc

SEQ ID NO: 3476 - RNA, 19 nt, Artificial Sequence
  Description of Artificial Sequence: Synthetic oligonucleotide
agaggcccaggggacagcc

SEQ ID NO: 3477 - RNA, 19 nt, Artificial Sequence
  Description of Artificial Sequence: Synthetic oligonucleotide
gaggcccaggggacagcca

SEQ ID NO: 3478 - RNA, 19 nt, Artificial Sequence
  Description of Artificial Sequence: Synthetic oligonucleotide
aggcccaggggacagccag

SEQ ID NO: 3479 - RNA, 19 nt, Artificial Sequence
  Description of Artificial Sequence: Synthetic oligonucleotide
ggcccaggggacagccagg

SEQ ID NO: 3480 - RNA, 19 nt, Artificial Sequence
  Description of Artificial Sequence: Synthetic oligonucleotide
gcccaggggacagccaggg

SEQ ID NO: 3481 - RNA, 19 nt, Artificial Sequence
  Description of Artificial Sequence: Synthetic oligonucleotide
cccaggggacagccaggga

SEQ ID NO: 3482 - RNA, 19 nt, Artificial Sequence
  Description of Artificial Sequence: Synthetic oligonucleotide
ccaggggacagccagggac

SEQ ID NO: 3483 - RNA, 19 nt, Artificial Sequence
  Description of Artificial Sequence: Synthetic oligonucleotide
caggggacagccagggaca

SEQ ID NO: 3484 - RNA, 19 nt, Artificial Sequence
  Description of Artificial Sequence: Synthetic oligonucleotide
aggggacagccagggacag

SEQ ID NO: 3485 - RNA, 19 nt, Artificial Sequence
  Description of Artificial Sequence: Synthetic oligonucleotide
ggggacagccagggacagg

SEQ ID NO: 3486 - RNA, 19 nt, Artificial Sequence
  Description of Artificial Sequence: Synthetic oligonucleotide
gggacagccagggacaggc

SEQ ID NO: 3487 - RNA, 19 nt, Artificial Sequence
  Description of Artificial Sequence: Synthetic oligonucleotide
ggacagccagggacaggca

SEQ ID NO: 3488 - RNA, 19 nt, Artificial Sequence
  Description of Artificial Sequence: Synthetic oligonucleotide
gacagccagggacaggcag

SEQ ID NO: 3489 - RNA, 19 nt, Artificial Sequence
  Description of Artificial Sequence: Synthetic oligonucleotide
acagccagggacaggcaga

SEQ ID NO: 3490 - RNA, 19 nt, Artificial Sequence
  Description of Artificial Sequence: Synthetic oligonucleotide
cagccagggacaggcagac

SEQ ID NO: 3491 - RNA, 19 nt, Artificial Sequence
  Description of Artificial Sequence: Synthetic oligonucleotide
agccagggacaggcagaca

SEQ ID NO: 3492 - RNA, 19 nt, Artificial Sequence
  Description of Artificial Sequence: Synthetic oligonucleotide
gccagggacaggcagacau

SEQ ID NO: 3493 - RNA, 19 nt, Artificial Sequence
  Description of Artificial Sequence: Synthetic oligonucleotide
ccagggacaggcagacaug

SEQ ID NO: 3494 - RNA, 19 nt, Artificial Sequence
  Description of Artificial Sequence: Synthetic oligonucleotide
cagggacaggcagacaugc

SEQ ID NO: 3495 - RNA, 19 nt, Artificial Sequence
  Description of Artificial Sequence: Synthetic oligonucleotide
agggacaggcagacaugca

SEQ ID NO: 3496 - RNA, 19 nt, Artificial Sequence
  Description of Artificial Sequence: Synthetic oligonucleotide
gggacaggcagacaugcag

SEQ ID NO: 3497 - RNA, 19 nt, Artificial Sequence
  Description of Artificial Sequence: Synthetic oligonucleotide
ggacaggcagacaugcagc

SEQ ID NO: 3498 - RNA, 19 nt, Artificial Sequence
  Description of Artificial Sequence: Synthetic oligonucleotide
gacaggcagacaugcagcc

SEQ ID NO: 3499 - RNA, 19 nt, Artificial Sequence
  Description of Artificial Sequence: Synthetic oligonucleotide
acaggcagacaugcagcca

SEQ ID NO: 3500 - RNA, 19 nt, Artificial Sequence
  Description of Artificial Sequence: Synthetic oligonucleotide
caggcagacaugcagccag

SEQ ID NO: 3501 - RNA, 19 nt, Artificial Sequence
  Description of Artificial Sequence: Synthetic oligonucleotide
aggcagacaugcagccagg

SEQ ID NO: 3502 - RNA, 19 nt, Artificial Sequence
  Description of Artificial Sequence: Synthetic oligonucleotide
ggcagacaugcagccaggg

SEQ ID NO: 3503 - RNA, 19 nt, Artificial Sequence
  Description of Artificial Sequence: Synthetic oligonucleotide
gcagacaugcagccagggc

SEQ ID NO: 3504 - RNA, 19 nt, Artificial Sequence
  Description of Artificial Sequence: Synthetic oligonucleotide
cagacaugcagccagggcu

SEQ ID NO: 3505 - RNA, 19 nt, Artificial Sequence
  Description of Artificial Sequence: Synthetic oligonucleotide
agacaugcagccagggcuc

SEQ ID NO: 3506 - RNA, 19 nt, Artificial Sequence
  Description of Artificial Sequence: Synthetic oligonucleotide
gacaugcagccagggcucc

SEQ ID NO: 3507 - RNA, 19 nt, Artificial Sequence
  Description of Artificial Sequence: Synthetic oligonucleotide
acaugcagccagggcucca

SEQ ID NO: 3508 - RNA, 19 nt, Artificial Sequence
  Description of Artificial Sequence: Synthetic oligonucleotide
caugcagccagggcuccag

SEQ ID NO: 3509 - RNA, 19 nt, Artificial Sequence
  Description of Artificial Sequence: Synthetic oligonucleotide
augcagccagggcuccagg

SEQ ID NO: 3510 - RNA, 19 nt, Artificial Sequence
  Description of Artificial Sequence: Synthetic oligonucleotide
ugcagccagggcuccaggg

SEQ ID NO: 3511 - RNA, 19 nt, Artificial Sequence
  Description of Artificial Sequence: Synthetic oligonucleotide
gcagccagggcuccagggc

SEQ ID NO: 3512 - RNA, 19 nt, Artificial Sequence
  Description of Artificial Sequence: Synthetic oligonucleotide
cagccagggcuccagggcc

SEQ ID NO: 3513 - RNA, 19 nt, Artificial Sequence
  Description of Artificial Sequence: Synthetic oligonucleotide
agccagggcuccagggccu

SEQ ID NO: 3514 - RNA, 19 nt, Artificial Sequence
  Description of Artificial Sequence: Synthetic oligonucleotide
gccagggcuccagggccug

SEQ ID NO: 3515 - RNA, 19 nt, Artificial Sequence
  Description of Artificial Sequence: Synthetic oligonucleotide
ccagggcuccagggccugg

SEQ ID NO: 3516 - RNA, 19 nt, Artificial Sequence
  Description of Artificial Sequence: Synthetic oligonucleotide
cagggcuccagggccugga

SEQ ID NO: 3517 - RNA, 19 nt, Artificial Sequence
  Description of Artificial Sequence: Synthetic oligonucleotide
agggcuccagggccuggac

SEQ ID NO: 3518 - RNA, 19 nt, Artificial Sequence
  Description of Artificial Sequence: Synthetic oligonucleotide
gggcuccagggccuggaca

SEQ ID NO: 3519 - RNA, 19 nt, Artificial Sequence
  Description of Artificial Sequence: Synthetic oligonucleotide
ggcuccagggccuggacag

SEQ ID NO: 3520 - RNA, 19 nt, Artificial Sequence
  Description of Artificial Sequence: Synthetic oligonucleotide
gcuccagggccuggacagg

SEQ ID NO: 3521 - RNA, 19 nt, Artificial Sequence
  Description of Artificial Sequence: Synthetic oligonucleotide
cuccagggccuggacaggg

SEQ ID NO: 3522 - RNA, 19 nt, Artificial Sequence
  Description of Artificial Sequence: Synthetic oligonucleotide
uccagggccuggacagggg

SEQ ID NO: 3523 - RNA, 19 nt, Artificial Sequence
  Description of Artificial Sequence: Synthetic oligonucleotide
ccagggccuggacaggggc

SEQ ID NO: 3524 - RNA, 19 nt, Artificial Sequence
  Description of Artificial Sequence: Synthetic oligonucleotide
cagggccuggacaggggcu

SEQ ID NO: 3525 - RNA, 19 nt, Artificial Sequence
  Description of Artificial Sequence: Synthetic oligonucleotide
agggccuggacaggggcug

SEQ ID NO: 3526 - RNA, 19 nt, Artificial Sequence
  Description of Artificial Sequence: Synthetic oligonucleotide
gggccuggacaggggcugc

SEQ ID NO: 3527 - RNA, 19 nt, Artificial Sequence
  Description of Artificial Sequence: Synthetic oligonucleotide
ggccuggacaggggcugcc

SEQ ID NO: 3528 - RNA, 19 nt, Artificial Sequence
  Description of Artificial Sequence: Synthetic oligonucleotide
gccuggacaggggcugcca

SEQ ID NO: 3529 - RNA, 19 nt, Artificial Sequence
  Description of Artificial Sequence: Synthetic oligonucleotide
ccuggacaggggcugccag

SEQ ID NO: 3530 - RNA, 19 nt, Artificial Sequence
  Description of Artificial Sequence: Synthetic oligonucleotide
cuggacaggggcugccagg

SEQ ID NO: 3531 - RNA, 19 nt, Artificial Sequence
  Description of Artificial Sequence: Synthetic oligonucleotide
uggacaggggcugccaggc

SEQ ID NO: 3532 - RNA, 19 nt, Artificial Sequence
  Description of Artificial Sequence: Synthetic oligonucleotide
ggacaggggcugccaggcc

SEQ ID NO: 3533 - RNA, 19 nt, Artificial Sequence
  Description of Artificial Sequence: Synthetic oligonucleotide
gacaggggcugccaggccc

SEQ ID NO: 3534 - RNA, 19 nt, Artificial Sequence
  Description of Artificial Sequence: Synthetic oligonucleotide
acaggggcugccaggcccu

SEQ ID NO: 3535 - RNA, 19 nt, Artificial Sequence
  Description of Artificial Sequence: Synthetic oligonucleotide
caggggcugccaggcccug

SEQ ID NO: 3536 - RNA, 19 nt, Artificial Sequence
  Description of Artificial Sequence: Synthetic oligonucleotide
aggggcugccaggcccugu

SEQ ID NO: 3537 - RNA, 19 nt, Artificial Sequence
  Description of Artificial Sequence: Synthetic oligonucleotide
ggggcugccaggcccugug

SEQ ID NO: 3538 - RNA, 19 nt, Artificial Sequence
  Description of Artificial Sequence: Synthetic oligonucleotide
gggcugccaggcccuguga

SEQ ID NO: 3539 - RNA, 19 nt, Artificial Sequence
  Description of Artificial Sequence: Synthetic oligonucleotide
ggcugccaggcccugugac

SEQ ID NO: 3540 - RNA, 19 nt, Artificial Sequence
  Description of Artificial Sequence: Synthetic oligonucleotide
gcugccaggcccugugaca

SEQ ID NO: 3541 - RNA, 19 nt, Artificial Sequence
  Description of Artificial Sequence: Synthetic oligonucleotide
cugccaggcccugugacag

SEQ ID NO: 3542 - RNA, 19 nt, Artificial Sequence
  Description of Artificial Sequence: Synthetic oligonucleotide
ugccaggcccugugacagg

SEQ ID NO: 3543 - RNA, 19 nt, Artificial Sequence
  Description of Artificial Sequence: Synthetic oligonucleotide
gccaggcccugugacagga

SEQ ID NO: 3544 - RNA, 19 nt, Artificial Sequence
  Description of Artificial Sequence: Synthetic oligonucleotide
ccaggcccugugacaggag

SEQ ID NO: 3545 - RNA, 19 nt, Artificial Sequence
  Description of Artificial Sequence: Synthetic oligonucleotide
caggcccugugacaggagg

SEQ ID NO: 3546 - RNA, 19 nt, Artificial Sequence
  Description of Artificial Sequence: Synthetic oligonucleotide
aggcccugugacaggagga

SEQ ID NO: 3547 - RNA, 19 nt, Artificial Sequence
  Description of Artificial Sequence: Synthetic oligonucleotide
ggcccugugacaggaggac

SEQ ID NO: 3548 - RNA, 19 nt, Artificial Sequence
  Description of Artificial Sequence: Synthetic oligonucleotide
gcccugugacaggaggacc

SEQ ID NO: 3549 - RNA, 19 nt, Artificial Sequence
  Description of Artificial Sequence: Synthetic oligonucleotide
cccugugacaggaggaccc

SEQ ID NO: 3550 - RNA, 19 nt, Artificial Sequence
  Description of Artificial Sequence: Synthetic oligonucleotide
ccugugacaggaggacccc

SEQ ID NO: 3551 - RNA, 19 nt, Artificial Sequence
  Description of Artificial Sequence: Synthetic oligonucleotide
cugugacaggaggaccccg

SEQ ID NO: 3552 - RNA, 19 nt, Artificial Sequence
  Description of Artificial Sequence: Synthetic oligonucleotide
ugugacaggaggaccccga

SEQ ID NO: 3553 - RNA, 19 nt, Artificial Sequence
  Description of Artificial Sequence: Synthetic oligonucleotide
gugacaggaggaccccgag

SEQ ID NO: 3554 - RNA, 19 nt, Artificial Sequence
  Description of Artificial Sequence: Synthetic oligonucleotide
ugacaggaggaccccgagc

SEQ ID NO: 3555 - RNA, 19 nt, Artificial Sequence
  Description of Artificial Sequence: Synthetic oligonucleotide
gacaggaggaccccgagcc

SEQ ID NO: 3556 - RNA, 19 nt, Artificial Sequence
  Description of Artificial Sequence: Synthetic oligonucleotide
acaggaggaccccgagccc

SEQ ID NO: 3557 - RNA, 19 nt, Artificial Sequence
  Description of Artificial Sequence: Synthetic oligonucleotide
caggaggaccccgagcccc

SEQ ID NO: 3558 - RNA, 19 nt, Artificial Sequence
  Description of Artificial Sequence: Synthetic oligonucleotide
aggaggaccccgagccccc

SEQ ID NO: 3559 - RNA, 19 nt, Artificial Sequence
  Description of Artificial Sequence: Synthetic oligonucleotide
ggaggaccccgagcccccg

SEQ ID NO: 3560 - RNA, 19 nt, Artificial Sequence
  Description of Artificial Sequence: Synthetic oligonucleotide
gaggaccccgagcccccgg

SEQ ID NO: 3561 - RNA, 19 nt, Artificial Sequence
  Description of Artificial Sequence: Synthetic oligonucleotide
aggaccccgagcccccggc

SEQ ID NO: 3562 - RNA, 19 nt, Artificial Sequence
  Description of Artificial Sequence: Synthetic oligonucleotide
ggaccccgagcccccggcc

SEQ ID NO: 3563 - RNA, 19 nt, Artificial Sequence
  Description of Artificial Sequence: Synthetic oligonucleotide
gaccccgagcccccggccc

SEQ ID NO: 3564 - RNA, 19 nt, Artificial Sequence
  Description of Artificial Sequence: Synthetic oligonucleotide
accccgagcccccggcccg

SEQ ID NO: 3565 - RNA, 19 nt, Artificial Sequence
  Description of Artificial Sequence: Synthetic oligonucleotide
ccccgagcccccggcccgg

SEQ ID NO: 3566 - RNA, 19 nt, Artificial Sequence
  Description of Artificial Sequence: Synthetic oligonucleotide
cccgagcccccggcccggg

SEQ ID NO: 3567 - RNA, 19 nt, Artificial Sequence
  Description of Artificial Sequence: Synthetic oligonucleotide
ccgagcccccggcccgggg

SEQ ID NO: 3568 - RNA, 19 nt, Artificial Sequence
  Description of Artificial Sequence: Synthetic oligonucleotide
cgagcccccggcccgggga

SEQ ID NO: 3569 - RNA, 19 nt, Artificial Sequence
  Description of Artificial Sequence: Synthetic oligonucleotide
gagcccccggcccggggag

SEQ ID NO: 3570 - RNA, 19 nt, Artificial Sequence
  Description of Artificial Sequence: Synthetic oligonucleotide
agcccccggcccggggagg

SEQ ID NO: 3571 - RNA, 19 nt, Artificial Sequence
  Description of Artificial Sequence: Synthetic oligonucleotide
gcccccggcccggggaggg

SEQ ID NO: 3572 - RNA, 19 nt, Artificial Sequence
  Description of Artificial Sequence: Synthetic oligonucleotide
cccccggcccggggagggg

SEQ ID NO: 3573 - RNA, 19 nt, Artificial Sequence
  Description of Artificial Sequence: Synthetic oligonucleotide
ccccggcccggggaggggc

SEQ ID NO: 3574 - RNA, 19 nt, Artificial Sequence
  Description of Artificial Sequence: Synthetic oligonucleotide
cccggcccggggaggggcc

SEQ ID NO: 3575 - RNA, 19 nt, Artificial Sequence
  Description of Artificial Sequence: Synthetic oligonucleotide
ccggcccggggaggggcca

SEQ ID NO: 3576 - RNA, 19 nt, Artificial Sequence
  Description of Artificial Sequence: Synthetic oligonucleotide
cggcccggggaggggccau

SEQ ID NO: 3577 - RNA, 19 nt, Artificial Sequence
  Description of Artificial Sequence: Synthetic oligonucleotide
ggcccggggaggggccaug

SEQ ID NO: 3578 - RNA, 19 nt, Artificial Sequence
  Description of Artificial Sequence: Synthetic oligonucleotide
gcccggggaggggccaugg

SEQ ID NO: 3579 - RNA, 19 nt, Artificial Sequence
  Description of Artificial Sequence: Synthetic oligonucleotide
cccggggaggggccauggu

SEQ ID NO: 3580 - RNA, 19 nt, Artificial Sequence
  Description of Artificial Sequence: Synthetic oligonucleotide
ccggggaggggccauggug

SEQ ID NO: 3581 - RNA, 19 nt, Artificial Sequence
  Description of Artificial Sequence: Synthetic oligonucleotide
cggggaggggccauggugc

SEQ ID NO: 3582 - RNA, 19 nt, Artificial Sequence
  Description of Artificial Sequence: Synthetic oligonucleotide
ggggaggggccauggugcu

SEQ ID NO: 3583 - RNA, 19 nt, Artificial Sequence
  Description of Artificial Sequence: Synthetic oligonucleotide
gggaggggccauggugcug

SEQ ID NO: 3584 - RNA, 19 nt, Artificial Sequence
  Description of Artificial Sequence: Synthetic oligonucleotide
ggaggggccauggugcugc

SEQ ID NO: 3585 - RNA, 19 nt, Artificial Sequence
  Description of Artificial Sequence: Synthetic oligonucleotide
gaggggccauggugcugcc

SEQ ID NO: 3586 - RNA, 19 nt, Artificial Sequence
  Description of Artificial Sequence: Synthetic oligonucleotide
aggggccauggugcugccu

SEQ ID NO: 3587 - RNA, 19 nt, Artificial Sequence
  Description of Artificial Sequence: Synthetic oligonucleotide
ggggccauggugcugccug

SEQ ID NO: 3588 - RNA, 19 nt, Artificial Sequence
  Description of Artificial Sequence: Synthetic oligonucleotide
gggccauggugcugccugu

SEQ ID NO: 3589 - RNA, 19 nt, Artificial Sequence
  Description of Artificial Sequence: Synthetic oligonucleotide
ggccauggugcugccuguc

SEQ ID NO: 3590 - RNA, 19 nt, Artificial Sequence
  Description of Artificial Sequence: Synthetic oligonucleotide
gccauggugcugccugucc

SEQ ID NO: 3591 - RNA, 19 nt, Artificial Sequence
  Description of Artificial Sequence: Synthetic oligonucleotide
ccauggugcugccugucca

SEQ ID NO: 3592 - RNA, 19 nt, Artificial Sequence
  Description of Artificial Sequence: Synthetic oligonucleotide
cauggugcugccuguccaa

SEQ ID NO: 3593 - RNA, 19 nt, Artificial Sequence
  Description of Artificial Sequence: Synthetic oligonucleotide
auggugcugccuguccaac

SEQ ID NO: 3594 - RNA, 19 nt, Artificial Sequence
  Description of Artificial Sequence: Synthetic oligonucleotide
uggugcugccuguccaaca

SEQ ID NO: 3595 - RNA, 19 nt, Artificial Sequence
  Description of Artificial Sequence: Synthetic oligonucleotide
ggugcugccuguccaacau

SEQ ID NO: 3596 - RNA, 19 nt, Artificial Sequence
  Description of Artificial Sequence: Synthetic oligonucleotide
gugcugccuguccaacaug

SEQ ID NO: 3597 - RNA, 19 nt, Artificial Sequence
  Description of Artificial Sequence: Synthetic oligonucleotide
ugcugccuguccaacaugu

SEQ ID NO: 3598 - RNA, 19 nt, Artificial Sequence
  Description of Artificial Sequence: Synthetic oligonucleotide
gcugccuguccaacauguc

SEQ ID NO: 3599 - RNA, 19 nt, Artificial Sequence
  Description of Artificial Sequence: Synthetic oligonucleotide
cugccuguccaacauguca

SEQ ID NO: 3600 - RNA, 19 nt, Artificial Sequence
  Description of Artificial Sequence: Synthetic oligonucleotide
ugccuguccaacaugucag

SEQ ID NO: 3601 - RNA, 19 nt, Artificial Sequence
  Description of Artificial Sequence: Synthetic oligonucleotide
gccuguccaacaugucagc

SEQ ID NO: 3602 - RNA, 19 nt, Artificial Sequence
  Description of Artificial Sequence: Synthetic oligonucleotide
ccuguccaacaugucagcc

SEQ ID NO: 3603 - RNA, 19 nt, Artificial Sequence
  Description of Artificial Sequence: Synthetic oligonucleotide
cuguccaacaugucagccg

SEQ ID NO: 3604 - RNA, 19 nt, Artificial Sequence
  Description of Artificial Sequence: Synthetic oligonucleotide
uguccaacaugucagccga

SEQ ID NO: 3605 - RNA, 19 nt, Artificial Sequence
  Description of Artificial Sequence: Synthetic oligonucleotide
guccaacaugucagccgag

SEQ ID NO: 3606 - RNA, 19 nt, Artificial Sequence
  Description of Artificial Sequence: Synthetic oligonucleotide
uccaacaugucagccgagg

SEQ ID NO: 3607 - RNA, 19 nt, Artificial Sequence
  Description of Artificial Sequence: Synthetic oligonucleotide
ccaacaugucagccgaggu

SEQ ID NO: 3608 - RNA, 19 nt, Artificial Sequence
  Description of Artificial Sequence: Synthetic oligonucleotide
caacaugucagccgaggug

SEQ ID NO: 3609 - RNA, 19 nt, Artificial Sequence
  Description of Artificial Sequence: Synthetic oligonucleotide
aacaugucagccgaggugc

SEQ ID NO: 3610 - RNA, 19 nt, Artificial Sequence
  Description of Artificial Sequence: Synthetic oligonucleotide
acaugucagccgaggugcg

SEQ ID NO: 3611 - RNA, 19 nt, Artificial Sequence
  Description of Artificial Sequence: Synthetic oligonucleotide
caugucagccgaggugcgg

SEQ ID NO: 3612 - RNA, 19 nt, Artificial Sequence
  Description of Artificial Sequence: Synthetic oligonucleotide
augucagccgaggugcggc

SEQ ID NO: 3613 - RNA, 19 nt, Artificial Sequence
  Description of Artificial Sequence: Synthetic oligonucleotide
ugucagccgaggugcggcu

SEQ ID NO: 3614 - RNA, 19 nt, Artificial Sequence
  Description of Artificial Sequence: Synthetic oligonucleotide
gucagccgaggugcggcug

SEQ ID NO: 3615 - RNA, 19 nt, Artificial Sequence
  Description of Artificial Sequence: Synthetic oligonucleotide
ucagccgaggugcggcuga

SEQ ID NO: 3616 - RNA, 19 nt, Artificial Sequence
  Description of Artificial Sequence: Synthetic oligonucleotide
cagccgaggugcggcugag

SEQ ID NO: 3617 - RNA, 19 nt, Artificial Sequence
  Description of Artificial Sequence: Synthetic oligonucleotide
agccgaggugcggcugagg

SEQ ID NO: 3618 - RNA, 19 nt, Artificial Sequence
  Description of Artificial Sequence: Synthetic oligonucleotide
gccgaggugcggcugaggc

SEQ ID NO: 3619 - RNA, 19 nt, Artificial Sequence
  Description of Artificial Sequence: Synthetic oligonucleotide
ccgaggugcggcugaggcg

SEQ ID NO: 3620 - RNA, 19 nt, Artificial Sequence
  Description of Artificial Sequence: Synthetic oligonucleotide
cgaggugcggcugaggcgg

SEQ ID NO: 3621 - RNA, 19 nt, Artificial Sequence
  Description of Artificial Sequence: Synthetic oligonucleotide
gaggugcggcugaggcggc

SEQ ID NO: 3622 - RNA, 19 nt, Artificial Sequence
  Description of Artificial Sequence: Synthetic oligonucleotide
aggugcggcugaggcggcu

SEQ ID NO: 3623 - RNA, 19 nt, Artificial Sequence
  Description of Artificial Sequence: Synthetic oligonucleotide
ggugcggcugaggcggcuc

SEQ ID NO: 3624 - RNA, 19 nt, Artificial Sequence
  Description of Artificial Sequence: Synthetic oligonucleotide
gugcggcugaggcggcucc

SEQ ID NO: 3625 - RNA, 19 nt, Artificial Sequence
  Description of Artificial Sequence: Synthetic oligonucleotide
ugcggcugaggcggcucca

SEQ ID NO: 3626 - RNA, 19 nt, Artificial Sequence
  Description of Artificial Sequence: Synthetic oligonucleotide
gcggcugaggcggcuccag

SEQ ID NO: 3627 - RNA, 19 nt, Artificial Sequence
  Description of Artificial Sequence: Synthetic oligonucleotide
cggcugaggcggcuccagc

SEQ ID NO: 3628 - RNA, 19 nt, Artificial Sequence
  Description of Artificial Sequence: Synthetic oligonucleotide
ggcugaggcggcuccagca

SEQ ID NO: 3629 - RNA, 19 nt, Artificial Sequence
  Description of Artificial Sequence: Synthetic oligonucleotide
gcugaggcggcuccagcag

SEQ ID NO: 3630 - RNA, 19 nt, Artificial Sequence
  Description of Artificial Sequence: Synthetic oligonucleotide
cugaggcggcuccagcagc

SEQ ID NO: 3631 - RNA, 19 nt, Artificial Sequence
  Description of Artificial Sequence: Synthetic oligonucleotide
ugaggcggcuccagcagcu

SEQ ID NO: 3632 - RNA, 19 nt, Artificial Sequence
  Description of Artificial Sequence: Synthetic oligonucleotide
gaggcggcuccagcagcug

SEQ ID NO: 3633 - RNA, 19 nt, Artificial Sequence
  Description of Artificial Sequence: Synthetic oligonucleotide
aggcggcuccagcagcugg

SEQ ID NO: 3634 - RNA, 19 nt, Artificial Sequence
  Description of Artificial Sequence: Synthetic oligonucleotide
ggcggcuccagcagcuggu

SEQ ID NO: 3635 - RNA, 19 nt, Artificial Sequence
  Description of Artificial Sequence: Synthetic oligonucleotide
gcggcuccagcagcuggug

SEQ ID NO: 3636 - RNA, 19 nt, Artificial Sequence
  Description of Artificial Sequence: Synthetic oligonucleotide
cggcuccagcagcuggugu

SEQ ID NO: 3637 - RNA, 19 nt, Artificial Sequence
  Description of Artificial Sequence: Synthetic oligonucleotide
ggcuccagcagcugguguu

SEQ ID NO: 3638 - RNA, 19 nt, Artificial Sequence
  Description of Artificial Sequence: Synthetic oligonucleotide
gcuccagcagcugguguug

SEQ ID NO: 3639 - RNA, 19 nt, Artificial Sequence
  Description of Artificial Sequence: Synthetic oligonucleotide
cuccagcagcugguguugg

SEQ ID NO: 3640 - RNA, 19 nt, Artificial Sequence
  Description of Artificial Sequence: Synthetic oligonucleotide
uccagcagcugguguugga

SEQ ID NO: 3641 - RNA, 19 nt, Artificial Sequence
  Description of Artificial Sequence: Synthetic oligonucleotide
ccagcagcugguguuggac

SEQ ID NO: 3642 - RNA, 19 nt, Artificial Sequence
  Description of Artificial Sequence: Synthetic oligonucleotide
cagcagcugguguuggacc

SEQ ID NO: 3643 - RNA, 19 nt, Artificial Sequence
  Description of Artificial Sequence: Synthetic oligonucleotide
agcagcugguguuggaccc

SEQ ID NO: 3644 - RNA, 19 nt, Artificial Sequence
  Description of Artificial Sequence: Synthetic oligonucleotide
gcagcugguguuggacccg

SEQ ID NO: 3645 - RNA, 19 nt, Artificial Sequence
  Description of Artificial Sequence: Synthetic oligonucleotide
cagcugguguuggacccgg

SEQ ID NO: 3646 - RNA, 19 nt, Artificial Sequence
  Description of Artificial Sequence: Synthetic oligonucleotide
agcugguguuggacccggg

SEQ ID NO: 3647 - RNA, 19 nt, Artificial Sequence
  Description of Artificial Sequence: Synthetic oligonucleotide
gcugguguuggacccgggc

SEQ ID NO: 3648 - RNA, 19 nt, Artificial Sequence
  Description of Artificial Sequence: Synthetic oligonucleotide
cugguguuggacccgggcu

SEQ ID NO: 3649 - RNA, 19 nt, Artificial Sequence
  Description of Artificial Sequence: Synthetic oligonucleotide
ugguguuggacccgggcuu

SEQ ID NO: 3650 - RNA, 19 nt, Artificial Sequence
  Description of Artificial Sequence: Synthetic oligonucleotide
gguguuggacccgggcuuc

SEQ ID NO: 3651 - RNA, 19 nt, Artificial Sequence
  Description of Artificial Sequence: Synthetic oligonucleotide
guguuggacccgggcuucc

SEQ ID NO: 3652 - RNA, 19 nt, Artificial Sequence
  Description of Artificial Sequence: Synthetic oligonucleotide
uguuggacccgggcuuccu

SEQ ID NO: 3653 - RNA, 19 nt, Artificial Sequence
  Description of Artificial Sequence: Synthetic oligonucleotide
guuggacccgggcuuccug

SEQ ID NO: 3654 - RNA, 19 nt, Artificial Sequence
  Description of Artificial Sequence: Synthetic oligonucleotide
uuggacccgggcuuccugg

SEQ ID NO: 3655 - RNA, 19 nt, Artificial Sequence
  Description of Artificial Sequence: Synthetic oligonucleotide
uggacccgggcuuccuggg

SEQ ID NO: 3656 - RNA, 19 nt, Artificial Sequence
  Description of Artificial Sequence: Synthetic oligonucleotide
ggacccgggcuuccugggg

SEQ ID NO: 3657 - RNA, 19 nt, Artificial Sequence
  Description of Artificial Sequence: Synthetic oligonucleotide
gacccgggcuuccuggggc

SEQ ID NO: 3658 - RNA, 19 nt, Artificial Sequence
  Description of Artificial Sequence: Synthetic oligonucleotide
acccgggcuuccuggggcu

SEQ ID NO: 3659 - RNA, 19 nt, Artificial Sequence
  Description of Artificial Sequence: Synthetic oligonucleotide
cccgggcuuccuggggcug

SEQ ID NO: 3660 - RNA, 19 nt, Artificial Sequence
  Description of Artificial Sequence: Synthetic oligonucleotide
ccgggcuuccuggggcugg

SEQ ID NO: 3661 - RNA, 19 nt, Artificial Sequence
  Description of Artificial Sequence: Synthetic oligonucleotide
cgggcuuccuggggcugga

SEQ ID NO: 3662 - RNA, 19 nt, Artificial Sequence
  Description of Artificial Sequence: Synthetic oligonucleotide
gggcuuccuggggcuggag

SEQ ID NO: 3663 - RNA, 19 nt, Artificial Sequence
  Description of Artificial Sequence: Synthetic oligonucleotide
ggcuuccuggggcuggagc

SEQ ID NO: 3664 - RNA, 19 nt, Artificial Sequence
  Description of Artificial Sequence: Synthetic oligonucleotide
gcuuccuggggcuggagcc

SEQ ID NO: 3665 - RNA, 19 nt, Artificial Sequence
  Description of Artificial Sequence: Synthetic oligonucleotide
cuuccuggggcuggagccc

SEQ ID NO: 3666 - RNA, 19 nt, Artificial Sequence
  Description of Artificial Sequence: Synthetic oligonucleotide
uuccuggggcuggagcccc

SEQ ID NO: 3667 - RNA, 19 nt, Artificial Sequence
  Description of Artificial Sequence: Synthetic oligonucleotide
uccuggggcuggagccccu

SEQ ID NO: 3668 - RNA, 19 nt, Artificial Sequence
  Description of Artificial Sequence: Synthetic oligonucleotide
ccuggggcuggagccccug

SEQ ID NO: 3669 - RNA, 19 nt, Artificial Sequence
  Description of Artificial Sequence: Synthetic oligonucleotide
cuggggcuggagccccugc

SEQ ID NO: 3670 - RNA, 19 nt, Artificial Sequence
  Description of Artificial Sequence: Synthetic oligonucleotide
uggggcuggagccccugcu

SEQ ID NO: 3671 - RNA, 19 nt, Artificial Sequence
  Description of Artificial Sequence: Synthetic oligonucleotide
ggggcuggagccccugcuc

SEQ ID NO: 3672 - RNA, 19 nt, Artificial Sequence
  Description of Artificial Sequence: Synthetic oligonucleotide
gggcuggagccccugcucg

SEQ ID NO: 3673 - RNA, 19 nt, Artificial Sequence
  Description of Artificial Sequence: Synthetic oligonucleotide
ggcuggagccccugcucga

SEQ ID NO: 3674 - RNA, 19 nt, Artificial Sequence
  Description of Artificial Sequence: Synthetic oligonucleotide
gcuggagccccugcucgac

SEQ ID NO: 3675 - RNA, 19 nt, Artificial Sequence
  Description of Artificial Sequence: Synthetic oligonucleotide
cuggagccccugcucgacc

SEQ ID NO: 3676 - RNA, 19 nt, Artificial Sequence
  Description of Artificial Sequence: Synthetic oligonucleotide
uggagccccugcucgaccu

SEQ ID NO: 3677 - RNA, 19 nt, Artificial Sequence
  Description of Artificial Sequence: Synthetic oligonucleotide
ggagccccugcucgaccuu

SEQ ID NO: 3678 - RNA, 19 nt, Artificial Sequence
  Description of Artificial Sequence: Synthetic oligonucleotide
gagccccugcucgaccuuc

SEQ ID NO: 3679 - RNA, 19 nt, Artificial Sequence
  Description of Artificial Sequence: Synthetic oligonucleotide
agccccugcucgaccuucu

SEQ ID NO: 3680 - RNA, 19 nt, Artificial Sequence
  Description of Artificial Sequence: Synthetic oligonucleotide
gccccugcucgaccuucuc

SEQ ID NO: 3681 - RNA, 19 nt, Artificial Sequence
  Description of Artificial Sequence: Synthetic oligonucleotide
ccccugcucgaccuucucc

SEQ ID NO: 3682 - RNA, 19 nt, Artificial Sequence
  Description of Artificial Sequence: Synthetic oligonucleotide
cccugcucgaccuucuccu

SEQ ID NO: 3683 - RNA, 19 nt, Artificial Sequence
  Description of Artificial Sequence: Synthetic oligonucleotide
ccugcucgaccuucuccug

SEQ ID NO: 3684 - RNA, 19 nt, Artificial Sequence
  Description of Artificial Sequence: Synthetic oligonucleotide
cugcucgaccuucuccugg

SEQ ID NO: 3685 - RNA, 19 nt, Artificial Sequence
  Description of Artificial Sequence: Synthetic oligonucleotide
ugcucgaccuucuccuggg

SEQ ID NO: 3686 - RNA, 19 nt, Artificial Sequence
  Description of Artificial Sequence: Synthetic oligonucleotide
gcucgaccuucuccugggc

SEQ ID NO: 3687 - RNA, 19 nt, Artificial Sequence
  Description of Artificial Sequence: Synthetic oligonucleotide
cucgaccuucuccugggcg

SEQ ID NO: 3688 - RNA, 19 nt, Artificial Sequence
  Description of Artificial Sequence: Synthetic oligonucleotide
ucgaccuucuccugggcgu

SEQ ID NO: 3689 - RNA, 19 nt, Artificial Sequence
  Description of Artificial Sequence: Synthetic oligonucleotide
cgaccuucuccugggcguc

SEQ ID NO: 3690 - RNA, 19 nt, Artificial Sequence
  Description of Artificial Sequence: Synthetic oligonucleotide
gaccuucuccugggcgucc

SEQ ID NO: 3691 - RNA, 19 nt, Artificial Sequence
  Description of Artificial Sequence: Synthetic oligonucleotide
accuucuccugggcgucca

SEQ ID NO: 3692 - RNA, 19 nt, Artificial Sequence
  Description of Artificial Sequence: Synthetic oligonucleotide
ccuucuccugggcguccac

SEQ ID NO: 3693 - RNA, 19 nt, Artificial Sequence
  Description of Artificial Sequence: Synthetic oligonucleotide
cuucuccugggcguccacc

SEQ ID NO: 3694 - RNA, 19 nt, Artificial Sequence
  Description of Artificial Sequence: Synthetic oligonucleotide
uucuccugggcguccacca

SEQ ID NO: 3695 - RNA, 19 nt, Artificial Sequence
  Description of Artificial Sequence: Synthetic oligonucleotide
ucuccugggcguccaccag

SEQ ID NO: 3696 - RNA, 19 nt, Artificial Sequence
  Description of Artificial Sequence: Synthetic oligonucleotide
cuccugggcguccaccagg

SEQ ID NO: 3697 - RNA, 19 nt, Artificial Sequence
  Description of Artificial Sequence: Synthetic oligonucleotide
uccugggcguccaccagga

SEQ ID NO: 3698 - RNA, 19 nt, Artificial Sequence
  Description of Artificial Sequence: Synthetic oligonucleotide
ccugggcguccaccaggag

SEQ ID NO: 3699 - RNA, 19 nt, Artificial Sequence
  Description of Artificial Sequence: Synthetic oligonucleotide
cugggcguccaccaggagc

SEQ ID NO: 3700 - RNA, 19 nt, Artificial Sequence
  Description of Artificial Sequence: Synthetic oligonucleotide
ugggcguccaccaggagcu

SEQ ID NO: 3701 - RNA, 19 nt, Artificial Sequence
  Description of Artificial Sequence: Synthetic oligonucleotide
gggcguccaccaggagcug

SEQ ID NO: 3702 - RNA, 19 nt, Artificial Sequence
  Description of Artificial Sequence: Synthetic oligonucleotide
ggcguccaccaggagcugg

SEQ ID NO: 3703 - RNA, 19 nt, Artificial Sequence
  Description of Artificial Sequence: Synthetic oligonucleotide
gcguccaccaggagcuggg

SEQ ID NO: 3704 - RNA, 19 nt, Artificial Sequence
  Description of Artificial Sequence: Synthetic oligonucleotide
cguccaccaggagcugggc

SEQ ID NO: 3705 - RNA, 19 nt, Artificial Sequence
  Description of Artificial Sequence: Synthetic oligonucleotide
guccaccaggagcugggcg

SEQ ID NO: 3706 - RNA, 19 nt, Artificial Sequence
  Description of Artificial Sequence: Synthetic oligonucleotide
uccaccaggagcugggcgc

SEQ ID NO: 3707 - RNA, 19 nt, Artificial Sequence
  Description of Artificial Sequence: Synthetic oligonucleotide
ccaccaggagcugggcgcc

SEQ ID NO: 3708 - RNA, 19 nt, Artificial Sequence
  Description of Artificial Sequence: Synthetic oligonucleotide
caccaggagcugggcgccu

SEQ ID NO: 3709 - RNA, 19 nt, Artificial Sequence
  Description of Artificial Sequence: Synthetic oligonucleotide
accaggagcugggcgccuc

SEQ ID NO: 3710 - RNA, 19 nt, Artificial Sequence
  Description of Artificial Sequence: Synthetic oligonucleotide
ccaggagcugggcgccucc

SEQ ID NO: 3711 - RNA, 19 nt, Artificial Sequence
  Description of Artificial Sequence: Synthetic oligonucleotide
caggagcugggcgccuccg

SEQ ID NO: 3712 - RNA, 19 nt, Artificial Sequence
  Description of Artificial Sequence: Synthetic oligonucleotide
aggagcugggcgccuccga

SEQ ID NO: 3713 - RNA, 19 nt, Artificial Sequence
  Description of Artificial Sequence: Synthetic oligonucleotide
ggagcugggcgccuccgaa

SEQ ID NO: 3714 - RNA, 19 nt, Artificial Sequence
  Description of Artificial Sequence: Synthetic oligonucleotide
gagcugggcgccuccgaac

SEQ ID NO: 3715 - RNA, 19 nt, Artificial Sequence
  Description of Artificial Sequence: Synthetic oligonucleotide
agcugggcgccuccgaacu

SEQ ID NO: 3716 - RNA, 19 nt, Artificial Sequence
  Description of Artificial Sequence: Synthetic oligonucleotide
gcugggcgccuccgaacug

SEQ ID NO: 3717 - RNA, 19 nt, Artificial Sequence
  Description of Artificial Sequence: Synthetic oligonucleotide
cugggcgccuccgaacugg

SEQ ID NO: 3718 - RNA, 19 nt, Artificial Sequence
  Description of Artificial Sequence: Synthetic oligonucleotide
ugggcgccuccgaacuggc

SEQ ID NO: 3719 - RNA, 19 nt, Artificial Sequence
  Description of Artificial Sequence: Synthetic oligonucleotide
gggcgccuccgaacuggcc

SEQ ID NO: 3720 - RNA, 19 nt, Artificial Sequence
  Description of Artificial Sequence: Synthetic oligonucleotide
ggcgccuccgaacuggccc

SEQ ID NO: 3721 - RNA, 19 nt, Artificial Sequence
  Description of Artificial Sequence: Synthetic oligonucleotide
gcgccuccgaacuggccca

SEQ ID NO: 3722 - RNA, 19 nt, Artificial Sequence
  Description of Artificial Sequence: Synthetic oligonucleotide
cgccuccgaacuggcccag

SEQ ID NO: 3723 - RNA, 19 nt, Artificial Sequence
  Description of Artificial Sequence: Synthetic oligonucleotide
gccuccgaacuggcccagg

SEQ ID NO: 3724 - RNA, 19 nt, Artificial Sequence
  Description of Artificial Sequence: Synthetic oligonucleotide
ccuccgaacuggcccagga

SEQ ID NO: 3725 - RNA, 19 nt, Artificial Sequence
  Description of Artificial Sequence: Synthetic oligonucleotide
cuccgaacuggcccaggac

SEQ ID NO: 3726 - RNA, 19 nt, Artificial Sequence
  Description of Artificial Sequence: Synthetic oligonucleotide
uccgaacuggcccaggaca

SEQ ID NO: 3727 - RNA, 19 nt, Artificial Sequence
  Description of Artificial Sequence: Synthetic oligonucleotide
ccgaacuggcccaggacaa

SEQ ID NO: 3728 - RNA, 19 nt, Artificial Sequence
  Description of Artificial Sequence: Synthetic oligonucleotide
cgaacuggcccaggacaag

SEQ ID NO: 3729 - RNA, 19 nt, Artificial Sequence
  Description of Artificial Sequence: Synthetic oligonucleotide
gaacuggcccaggacaagu

SEQ ID NO: 3730 - RNA, 19 nt, Artificial Sequence
  Description of Artificial Sequence: Synthetic oligonucleotide
aacuggcccaggacaagua

SEQ ID NO: 3731 - RNA, 19 nt, Artificial Sequence
  Description of Artificial Sequence: Synthetic oligonucleotide
acuggcccaggacaaguac

SEQ ID NO: 3732 - RNA, 19 nt, Artificial Sequence
  Description of Artificial Sequence: Synthetic oligonucleotide
cuggcccaggacaaguacg

SEQ ID NO: 3733 - RNA, 19 nt, Artificial Sequence
  Description of Artificial Sequence: Synthetic oligonucleotide
uggcccaggacaaguacgu

SEQ ID NO: 3734 - RNA, 19 nt, Artificial Sequence
  Description of Artificial Sequence: Synthetic oligonucleotide
ggcccaggacaaguacgug

SEQ ID NO: 3735 - RNA, 19 nt, Artificial Sequence
  Description of Artificial Sequence: Synthetic oligonucleotide
gcccaggacaaguacgugg

SEQ ID NO: 3736 - RNA, 19 nt, Artificial Sequence
  Description of Artificial Sequence: Synthetic oligonucleotide
cccaggacaaguacguggc

SEQ ID NO: 3737 - RNA, 19 nt, Artificial Sequence
  Description of Artificial Sequence: Synthetic oligonucleotide
ccaggacaaguacguggcc

SEQ ID NO: 3738 - RNA, 19 nt, Artificial Sequence
  Description of Artificial Sequence: Synthetic oligonucleotide
caggacaaguacguggccg

SEQ ID NO: 3739 - RNA, 19 nt, Artificial Sequence
  Description of Artificial Sequence: Synthetic oligonucleotide
aggacaaguacguggccga

SEQ ID NO: 3740 - RNA, 19 nt, Artificial Sequence
  Description of Artificial Sequence: Synthetic oligonucleotide
ggacaaguacguggccgac

SEQ ID NO: 3741 - RNA, 19 nt, Artificial Sequence
  Description of Artificial Sequence: Synthetic oligonucleotide
gacaaguacguggccgacu

SEQ ID NO: 3742 - RNA, 19 nt, Artificial Sequence
  Description of Artificial Sequence: Synthetic oligonucleotide
acaaguacguggccgacuu

SEQ ID NO: 3743 - RNA, 19 nt, Artificial Sequence
  Description of Artificial Sequence: Synthetic oligonucleotide
caaguacguggccgacuuc

SEQ ID NO: 3744 - RNA, 19 nt, Artificial Sequence
  Description of Artificial Sequence: Synthetic oligonucleotide
aaguacguggccgacuucu

SEQ ID NO: 3745 - RNA, 19 nt, Artificial Sequence
  Description of Artificial Sequence: Synthetic oligonucleotide
aguacguggccgacuucuu

SEQ ID NO: 3746 - RNA, 19 nt, Artificial Sequence
  Description of Artificial Sequence: Synthetic oligonucleotide
guacguggccgacuucuug

SEQ ID NO: 3747 - RNA, 19 nt, Artificial Sequence
  Description of Artificial Sequence: Synthetic oligonucleotide
uacguggccgacuucuugc

SEQ ID NO: 3748 - RNA, 19 nt, Artificial Sequence
  Description of Artificial Sequence: Synthetic oligonucleotide
acguggccgacuucuugca

SEQ ID NO: 3749 - RNA, 19 nt, Artificial Sequence
  Description of Artificial Sequence: Synthetic oligonucleotide
cguggccgacuucuugcag

SEQ ID NO: 3750 - RNA, 19 nt, Artificial Sequence
  Description of Artificial Sequence: Synthetic oligonucleotide
guggccgacuucuugcagu

SEQ ID NO: 3751 - RNA, 19 nt, Artificial Sequence
  Description of Artificial Sequence: Synthetic oligonucleotide
uggccgacuucuugcagug

SEQ ID NO: 3752 - RNA, 19 nt, Artificial Sequence
  Description of Artificial Sequence: Synthetic oligonucleotide
ggccgacuucuugcagugg

SEQ ID NO: 3753 - RNA, 19 nt, Artificial Sequence
  Description of Artificial Sequence: Synthetic oligonucleotide
gccgacuucuugcaguggg

SEQ ID NO: 3754 - RNA, 19 nt, Artificial Sequence
  Description of Artificial Sequence: Synthetic oligonucleotide
ccgacuucuugcagugggc

SEQ ID NO: 3755 - RNA, 19 nt, Artificial Sequence
  Description of Artificial Sequence: Synthetic oligonucleotide
cgacuucuugcagugggcg

SEQ ID NO: 3756 - RNA, 19 nt, Artificial Sequence
  Description of Artificial Sequence: Synthetic oligonucleotide
gacuucuugcagugggcgg

SEQ ID NO: 3757 - RNA, 19 nt, Artificial Sequence
  Description of Artificial Sequence: Synthetic oligonucleotide
acuucuugcagugggcgga

SEQ ID NO: 3758 - RNA, 19 nt, Artificial Sequence
  Description of Artificial Sequence: Synthetic oligonucleotide
cuucuugcagugggcggag

SEQ ID NO: 3759 - RNA, 19 nt, Artificial Sequence
  Description of Artificial Sequence: Synthetic oligonucleotide
uucuugcagugggcggagc

SEQ ID NO: 3760 - RNA, 19 nt, Artificial Sequence
  Description of Artificial Sequence: Synthetic oligonucleotide
ucuugcagugggcggagcc

SEQ ID NO: 3761 - RNA, 19 nt, Artificial Sequence
  Description of Artificial Sequence: Synthetic oligonucleotide
cuugcagugggcggagccc

SEQ ID NO: 3762 - RNA, 19 nt, Artificial Sequence
  Description of Artificial Sequence: Synthetic oligonucleotide
uugcagugggcggagccca

SEQ ID NO: 3763 - RNA, 19 nt, Artificial Sequence
  Description of Artificial Sequence: Synthetic oligonucleotide
ugcagugggcggagcccau

SEQ ID NO: 3764 - RNA, 19 nt, Artificial Sequence
  Description of Artificial Sequence: Synthetic oligonucleotide
gcagugggcggagcccauc

SEQ ID NO: 3765 - RNA, 19 nt, Artificial Sequence
  Description of Artificial Sequence: Synthetic oligonucleotide
cagugggcggagcccaucg

SEQ ID NO: 3766 - RNA, 19 nt, Artificial Sequence
  Description of Artificial Sequence: Synthetic oligonucleotide
agugggcggagcccaucgu

SEQ ID NO: 3767 - RNA, 19 nt, Artificial Sequence
  Description of Artificial Sequence: Synthetic oligonucleotide
gugggcggagcccaucgug

SEQ ID NO: 3768 - RNA, 19 nt, Artificial Sequence
  Description of Artificial Sequence: Synthetic oligonucleotide
ugggcggagcccaucgugg

SEQ ID NO: 3769 - RNA, 19 nt, Artificial Sequence
  Description of Artificial Sequence: Synthetic oligonucleotide
gggcggagcccaucguggu

SEQ ID NO: 3770 - RNA, 19 nt, Artificial Sequence
  Description of Artificial Sequence: Synthetic oligonucleotide
ggcggagcccaucguggug

SEQ ID NO: 3771 - RNA, 19 nt, Artificial Sequence
  Description of Artificial Sequence: Synthetic oligonucleotide
gcggagcccaucgugguga

SEQ ID NO: 3772 - RNA, 19 nt, Artificial Sequence
  Description of Artificial Sequence: Synthetic oligonucleotide
cggagcccaucguggugag

SEQ ID NO: 3773 - RNA, 19 nt, Artificial Sequence
  Description of Artificial Sequence: Synthetic oligonucleotide
ggagcccaucguggugagg

SEQ ID NO: 3774 - RNA, 19 nt, Artificial Sequence
  Description of Artificial Sequence: Synthetic oligonucleotide
gagcccaucguggugaggc

SEQ ID NO: 3775 - RNA, 19 nt, Artificial Sequence
  Description of Artificial Sequence: Synthetic oligonucleotide
agcccaucguggugaggcu

SEQ ID NO: 3776 - RNA, 19 nt, Artificial Sequence
  Description of Artificial Sequence: Synthetic oligonucleotide
gcccaucguggugaggcuu

SEQ ID NO: 3777 - RNA, 19 nt, Artificial Sequence
  Description of Artificial Sequence: Synthetic oligonucleotide
cccaucguggugaggcuua

SEQ ID NO: 3778 - RNA, 19 nt, Artificial Sequence
  Description of Artificial Sequence: Synthetic oligonucleotide
ccaucguggugaggcuuaa

SEQ ID NO: 3779 - RNA, 19 nt, Artificial Sequence
  Description of Artificial Sequence: Synthetic oligonucleotide
caucguggugaggcuuaag

SEQ ID NO: 3780 - RNA, 19 nt, Artificial Sequence
  Description of Artificial Sequence: Synthetic oligonucleotide
aucguggugaggcuuaagg

SEQ ID NO: 3781 - RNA, 19 nt, Artificial Sequence
  Description of Artificial Sequence: Synthetic oligonucleotide
ucguggugaggcuuaagga

SEQ ID NO: 3782 - RNA, 19 nt, Artificial Sequence
  Description of Artificial Sequence: Synthetic oligonucleotide
cguggugaggcuuaaggag

SEQ ID NO: 3783 - RNA, 19 nt, Artificial Sequence
  Description of Artificial Sequence: Synthetic oligonucleotide
guggugaggcuuaaggagg

SEQ ID NO: 3784 - RNA, 19 nt, Artificial Sequence
  Description of Artificial Sequence: Synthetic oligonucleotide
uggugaggcuuaaggaggu

SEQ ID NO: 3785 - RNA, 19 nt, Artificial Sequence
  Description of Artificial Sequence: Synthetic oligonucleotide
ggugaggcuuaaggagguc

SEQ ID NO: 3786 - RNA, 19 nt, Artificial Sequence
  Description of Artificial Sequence: Synthetic oligonucleotide
gugaggcuuaaggaggucc

SEQ ID NO: 3787 - RNA, 19 nt, Artificial Sequence
  Description of Artificial Sequence: Synthetic oligonucleotide
ugaggcuuaaggagguccg

SEQ ID NO: 3788 - RNA, 19 nt, Artificial Sequence
  Description of Artificial Sequence: Synthetic oligonucleotide
gaggcuuaaggagguccga

SEQ ID NO: 3789 - RNA, 19 nt, Artificial Sequence
  Description of Artificial Sequence: Synthetic oligonucleotide
aggcuuaaggagguccgac

SEQ ID NO: 3790 - RNA, 19 nt, Artificial Sequence
  Description of Artificial Sequence: Synthetic oligonucleotide
ggcuuaaggagguccgacu

SEQ ID NO: 3791 - RNA, 19 nt, Artificial Sequence
  Description of Artificial Sequence: Synthetic oligonucleotide
gcuuaaggagguccgacug

SEQ ID NO: 3792 - RNA, 19 nt, Artificial Sequence
  Description of Artificial Sequence: Synthetic oligonucleotide
cuuaaggagguccgacugc

SEQ ID NO: 3793 - RNA, 19 nt, Artificial Sequence
  Description of Artificial Sequence: Synthetic oligonucleotide
uuaaggagguccgacugca

SEQ ID NO: 3794 - RNA, 19 nt, Artificial Sequence
  Description of Artificial Sequence: Synthetic oligonucleotide
uaaggagguccgacugcag

SEQ ID NO: 3795 - RNA, 19 nt, Artificial Sequence
  Description of Artificial Sequence: Synthetic oligonucleotide
aaggagguccgacugcaga

SEQ ID NO: 3796 - RNA, 19 nt, Artificial Sequence
  Description of Artificial Sequence: Synthetic oligonucleotide
aggagguccgacugcagag

SEQ ID NO: 3797 - RNA, 19 nt, Artificial Sequence
  Description of Artificial Sequence: Synthetic oligonucleotide
ggagguccgacugcagagg

SEQ ID NO: 3798 - RNA, 19 nt, Artificial Sequence
  Description of Artificial Sequence: Synthetic oligonucleotide
gagguccgacugcagaggg

SEQ ID NO: 3799 - RNA, 19 nt, Artificial Sequence
  Description of Artificial Sequence: Synthetic oligonucleotide
agguccgacugcagaggga

SEQ ID NO: 3800 - RNA, 19 nt, Artificial Sequence
  Description of Artificial Sequence: Synthetic oligonucleotide
gguccgacugcagagggac

SEQ ID NO: 3801 - RNA, 19 nt, Artificial Sequence
  Description of Artificial Sequence: Synthetic oligonucleotide
guccgacugcagagggacg

SEQ ID NO: 3802 - RNA, 19 nt, Artificial Sequence
  Description of Artificial Sequence: Synthetic oligonucleotide
uccgacugcagagggacga

SEQ ID NO: 3803 - RNA, 19 nt, Artificial Sequence
  Description of Artificial Sequence: Synthetic oligonucleotide
ccgacugcagagggacgac

SEQ ID NO: 3804 - RNA, 19 nt, Artificial Sequence
  Description of Artificial Sequence: Synthetic oligonucleotide
cgacugcagagggacgacu

SEQ ID NO: 3805 - RNA, 19 nt, Artificial Sequence
  Description of Artificial Sequence: Synthetic oligonucleotide
gacugcagagggacgacuu

SEQ ID NO: 3806 - RNA, 19 nt, Artificial Sequence
  Description of Artificial Sequence: Synthetic oligonucleotide
acugcagagggacgacuuc

SEQ ID NO: 3807 - RNA, 19 nt, Artificial Sequence
  Description of Artificial Sequence: Synthetic oligonucleotide
cugcagagggacgacuucg

SEQ ID NO: 3808 - RNA, 19 nt, Artificial Sequence
  Description of Artificial Sequence: Synthetic oligonucleotide
ugcagagggacgacuucga

SEQ ID NO: 3809 - RNA, 19 nt, Artificial Sequence
  Description of Artificial Sequence: Synthetic oligonucleotide
gcagagggacgacuucgag

SEQ ID NO: 3810 - RNA, 19 nt, Artificial Sequence
  Description of Artificial Sequence: Synthetic oligonucleotide
cagagggacgacuucgaga

SEQ ID NO: 3811 - RNA, 19 nt, Artificial Sequence
  Description of Artificial Sequence: Synthetic oligonucleotide
agagggacgacuucgagau

SEQ ID NO: 3812 - RNA, 19 nt, Artificial Sequence
  Description of Artificial Sequence: Synthetic oligonucleotide
gagggacgacuucgagauu

SEQ ID NO: 3813 - RNA, 19 nt, Artificial Sequence
  Description of Artificial Sequence: Synthetic oligonucleotide
agggacgacuucgagauuc

SEQ ID NO: 3814 - RNA, 19 nt, Artificial Sequence
  Description of Artificial Sequence: Synthetic oligonucleotide
gggacgacuucgagauucu

SEQ ID NO: 3815 - RNA, 19 nt, Artificial Sequence
  Description of Artificial Sequence: Synthetic oligonucleotide
ggacgacuucgagauucug

SEQ ID NO: 3816 - RNA, 19 nt, Artificial Sequence
  Description of Artificial Sequence: Synthetic oligonucleotide
gacgacuucgagauucuga

SEQ ID NO: 3817 - RNA, 19 nt, Artificial Sequence
  Description of Artificial Sequence: Synthetic oligonucleotide
acgacuucgagauucugaa

SEQ ID NO: 3818 - RNA, 19 nt, Artificial Sequence
  Description of Artificial Sequence: Synthetic oligonucleotide
cgacuucgagauucugaag

SEQ ID NO: 3819 - RNA, 19 nt, Artificial Sequence
  Description of Artificial Sequence: Synthetic oligonucleotide
gacuucgagauucugaagg

SEQ ID NO: 3820 - RNA, 19 nt, Artificial Sequence
  Description of Artificial Sequence: Synthetic oligonucleotide
acuucgagauucugaaggu

SEQ ID NO: 3821 - RNA, 19 nt, Artificial Sequence
  Description of Artificial Sequence: Synthetic oligonucleotide
cuucgagauucugaaggug

SEQ ID NO: 3822 - RNA, 19 nt, Artificial Sequence
  Description of Artificial Sequence: Synthetic oligonucleotide
uucgagauucugaagguga

SEQ ID NO: 3823 - RNA, 19 nt, Artificial Sequence
  Description of Artificial Sequence: Synthetic oligonucleotide
ucgagauucugaaggugau

SEQ ID NO: 3824 - RNA, 19 nt, Artificial Sequence
  Description of Artificial Sequence: Synthetic oligonucleotide
cgagauucugaaggugauc

SEQ ID NO: 3825 - RNA, 19 nt, Artificial Sequence
  Description of Artificial Sequence: Synthetic oligonucleotide
gagauucugaaggugaucg

SEQ ID NO: 3826 - RNA, 19 nt, Artificial Sequence
  Description of Artificial Sequence: Synthetic oligonucleotide
agauucugaaggugaucgg

SEQ ID NO: 3827 - RNA, 19 nt, Artificial Sequence
  Description of Artificial Sequence: Synthetic oligonucleotide
gauucugaaggugaucgga

SEQ ID NO: 3828 - RNA, 19 nt, Artificial Sequence
  Description of Artificial Sequence: Synthetic oligonucleotide
auucugaaggugaucggac

SEQ ID NO: 3829 - RNA, 19 nt, Artificial Sequence
  Description of Artificial Sequence: Synthetic oligonucleotide
uucugaaggugaucggacg

SEQ ID NO: 3830 - RNA, 19 nt, Artificial Sequence
  Description of Artificial Sequence: Synthetic oligonucleotide
ucugaaggugaucggacgc

SEQ ID NO: 3831 - RNA, 19 nt, Artificial Sequence
  Description of Artificial Sequence: Synthetic oligonucleotide
cugaaggugaucggacgcg

SEQ ID NO: 3832 - RNA, 19 nt, Artificial Sequence
  Description of Artificial Sequence: Synthetic oligonucleotide
ugaaggugaucggacgcgg

SEQ ID NO: 3833 - RNA, 19 nt, Artificial Sequence
  Description of Artificial Sequence: Synthetic oligonucleotide
gaaggugaucggacgcggg

SEQ ID NO: 3834 - RNA, 19 nt, Artificial Sequence
  Description of Artificial Sequence: Synthetic oligonucleotide
aaggugaucggacgcgggg

SEQ ID NO: 3835 - RNA, 19 nt, Artificial Sequence
  Description of Artificial Sequence: Synthetic oligonucleotide
aggugaucggacgcggggc

SEQ ID NO: 3836 - RNA, 19 nt, Artificial Sequence
  Description of Artificial Sequence: Synthetic oligonucleotide
ggugaucggacgcggggcg

SEQ ID NO: 3837 - RNA, 19 nt, Artificial Sequence
  Description of Artificial Sequence: Synthetic oligonucleotide
gugaucggacgcggggcgu

SEQ ID NO: 3838 - RNA, 19 nt, Artificial Sequence
  Description of Artificial Sequence: Synthetic oligonucleotide
ugaucggacgcggggcguu

SEQ ID NO: 3839 - RNA, 19 nt, Artificial Sequence
  Description of Artificial Sequence: Synthetic oligonucleotide
gaucggacgcggggcguuc

SEQ ID NO: 3840 - RNA, 19 nt, Artificial Sequence
  Description of Artificial Sequence: Synthetic oligonucleotide
aucggacgcggggcguuca

SEQ ID NO: 3841 - RNA, 19 nt, Artificial Sequence
  Description of Artificial Sequence: Synthetic oligonucleotide
ucggacgcggggcguucag

SEQ ID NO: 3842 - RNA, 19 nt, Artificial Sequence
  Description of Artificial Sequence: Synthetic oligonucleotide
cggacgcggggcguucagc

SEQ ID NO: 3843 - RNA, 19 nt, Artificial Sequence
  Description of Artificial Sequence: Synthetic oligonucleotide
ggacgcggggcguucagcg

SEQ ID NO: 3844 - RNA, 19 nt, Artificial Sequence
  Description of Artificial Sequence: Synthetic oligonucleotide
gacgcggggcguucagcga

SEQ ID NO: 3845 - RNA, 19 nt, Artificial Sequence
  Description of Artificial Sequence: Synthetic oligonucleotide
acgcggggcguucagcgag

SEQ ID NO: 3846 - RNA, 19 nt, Artificial Sequence
  Description of Artificial Sequence: Synthetic oligonucleotide
cgcggggcguucagcgagg

SEQ ID NO: 3847 - RNA, 19 nt, Artificial Sequence
  Description of Artificial Sequence: Synthetic oligonucleotide
gcggggcguucagcgaggu

SEQ ID NO: 3848 - RNA, 19 nt, Artificial Sequence
  Description of Artificial Sequence: Synthetic oligonucleotide
cggggcguucagcgaggua

SEQ ID NO: 3849 - RNA, 19 nt, Artificial Sequence
  Description of Artificial Sequence: Synthetic oligonucleotide
ggggcguucagcgagguag

SEQ ID NO: 3850 - RNA, 19 nt, Artificial Sequence
  Description of Artificial Sequence: Synthetic oligonucleotide
gggcguucagcgagguagc

SEQ ID NO: 3851 - RNA, 19 nt, Artificial Sequence
  Description of Artificial Sequence: Synthetic oligonucleotide
ggcguucagcgagguagcg

SEQ ID NO: 3852 - RNA, 19 nt, Artificial Sequence
  Description of Artificial Sequence: Synthetic oligonucleotide
gcguucagcgagguagcgg

SEQ ID NO: 3853 - RNA, 19 nt, Artificial Sequence
  Description of Artificial Sequence: Synthetic oligonucleotide
cguucagcgagguagcggu

SEQ ID NO: 3854 - RNA, 19 nt, Artificial Sequence
  Description of Artificial Sequence: Synthetic oligonucleotide
guucagcgagguagcggua

SEQ ID NO: 3855 - RNA, 19 nt, Artificial Sequence
  Description of Artificial Sequence: Synthetic oligonucleotide
uucagcgagguagcgguag

SEQ ID NO: 3856 - RNA, 19 nt, Artificial Sequence
  Description of Artificial Sequence: Synthetic oligonucleotide
ucagcgagguagcgguagu

SEQ ID NO: 3857 - RNA, 19 nt, Artificial Sequence
  Description of Artificial Sequence: Synthetic oligonucleotide
cagcgagguagcgguagug

SEQ ID NO: 3858 - RNA, 19 nt, Artificial Sequence
  Description of Artificial Sequence: Synthetic oligonucleotide
agcgagguagcgguaguga

SEQ ID NO: 3859 - RNA, 19 nt, Artificial Sequence
  Description of Artificial Sequence: Synthetic oligonucleotide
gcgagguagcgguagugaa

SEQ ID NO: 3860 - RNA, 19 nt, Artificial Sequence
  Description of Artificial Sequence: Synthetic oligonucleotide
cgagguagcgguagugaag

SEQ ID NO: 3861 - RNA, 19 nt, Artificial Sequence
  Description of Artificial Sequence: Synthetic oligonucleotide
gagguagcgguagugaaga

SEQ ID NO: 3862 - RNA, 19 nt, Artificial Sequence
  Description of Artificial Sequence: Synthetic oligonucleotide
agguagcgguagugaagau

SEQ ID NO: 3863 - RNA, 19 nt, Artificial Sequence
  Description of Artificial Sequence: Synthetic oligonucleotide
gguagcgguagugaagaug

SEQ ID NO: 3864 - RNA, 19 nt, Artificial Sequence
  Description of Artificial Sequence: Synthetic oligonucleotide
guagcgguagugaagauga

SEQ ID NO: 3865 - RNA, 19 nt, Artificial Sequence
  Description of Artificial Sequence: Synthetic oligonucleotide
uagcgguagugaagaugaa

SEQ ID NO: 3866 - RNA, 19 nt, Artificial Sequence
  Description of Artificial Sequence: Synthetic oligonucleotide
agcgguagugaagaugaag

SEQ ID NO: 3867 - RNA, 19 nt, Artificial Sequence
  Description of Artificial Sequence: Synthetic oligonucleotide
gcgguagugaagaugaagc

SEQ ID NO: 3868 - RNA, 19 nt, Artificial Sequence
  Description of Artificial Sequence: Synthetic oligonucleotide
cgguagugaagaugaagca

SEQ ID NO: 3869 - RNA, 19 nt, Artificial Sequence
  Description of Artificial Sequence: Synthetic oligonucleotide
gguagugaagaugaagcag

SEQ ID NO: 3870 - RNA, 19 nt, Artificial Sequence
  Description of Artificial Sequence: Synthetic oligonucleotide
guagugaagaugaagcaga

SEQ ID NO: 3871 - RNA, 19 nt, Artificial Sequence
  Description of Artificial Sequence: Synthetic oligonucleotide
uagugaagaugaagcagac

SEQ ID NO: 3872 - RNA, 19 nt, Artificial Sequence
  Description of Artificial Sequence: Synthetic oligonucleotide
agugaagaugaagcagacg

SEQ ID NO: 3873 - RNA, 19 nt, Artificial Sequence
  Description of Artificial Sequence: Synthetic oligonucleotide
gugaagaugaagcagacgg

SEQ ID NO: 3874 - RNA, 19 nt, Artificial Sequence
  Description of Artificial Sequence: Synthetic oligonucleotide
ugaagaugaagcagacggg

SEQ ID NO: 3875 - RNA, 19 nt, Artificial Sequence
  Description of Artificial Sequence: Synthetic oligonucleotide
gaagaugaagcagacgggc

SEQ ID NO: 3876 - RNA, 19 nt, Artificial Sequence
  Description of Artificial Sequence: Synthetic oligonucleotide
aagaugaagcagacgggcc

SEQ ID NO: 3877 - RNA, 19 nt, Artificial Sequence
  Description of Artificial Sequence: Synthetic oligonucleotide
agaugaagcagacgggcca

SEQ ID NO: 3878 - RNA, 19 nt, Artificial Sequence
  Description of Artificial Sequence: Synthetic oligonucleotide
gaugaagcagacgggccag

SEQ ID NO: 3879 - RNA, 19 nt, Artificial Sequence
  Description of Artificial Sequence: Synthetic oligonucleotide
augaagcagacgggccagg

SEQ ID NO: 3880 - RNA, 19 nt, Artificial Sequence
  Description of Artificial Sequence: Synthetic oligonucleotide
ugaagcagacgggccaggu

SEQ ID NO: 3881 - RNA, 19 nt, Artificial Sequence
  Description of Artificial Sequence: Synthetic oligonucleotide
gaagcagacgggccaggug

SEQ ID NO: 3882 - RNA, 19 nt, Artificial Sequence
  Description of Artificial Sequence: Synthetic oligonucleotide
aagcagacgggccaggugu

SEQ ID NO: 3883 - RNA, 19 nt, Artificial Sequence
  Description of Artificial Sequence: Synthetic oligonucleotide
agcagacgggccaggugua

SEQ ID NO: 3884 - RNA, 19 nt, Artificial Sequence
  Description of Artificial Sequence: Synthetic oligonucleotide
gcagacgggccagguguau

SEQ ID NO: 3885 - RNA, 19 nt, Artificial Sequence
  Description of Artificial Sequence: Synthetic oligonucleotide
cagacgggccagguguaug

SEQ ID NO: 3886 - RNA, 19 nt, Artificial Sequence
  Description of Artificial Sequence: Synthetic oligonucleotide
agacgggccagguguaugc

SEQ ID NO: 3887 - RNA, 19 nt, Artificial Sequence
  Description of Artificial Sequence: Synthetic oligonucleotide
gacgggccagguguaugcc

SEQ ID NO: 3888 - RNA, 19 nt, Artificial Sequence
  Description of Artificial Sequence: Synthetic oligonucleotide
acgggccagguguaugcca

SEQ ID NO: 3889 - RNA, 19 nt, Artificial Sequence
  Description of Artificial Sequence: Synthetic oligonucleotide
cgggccagguguaugccau

SEQ ID NO: 3890 - RNA, 19 nt, Artificial Sequence
  Description of Artificial Sequence: Synthetic oligonucleotide
gggccagguguaugccaug

SEQ ID NO: 3891 - RNA, 19 nt, Artificial Sequence
  Description of Artificial Sequence: Synthetic oligonucleotide
ggccagguguaugccauga

SEQ ID NO: 3892 - RNA, 19 nt, Artificial Sequence
  Description of Artificial Sequence: Synthetic oligonucleotide
gccagguguaugccaugaa

SEQ ID NO: 3893 - RNA, 19 nt, Artificial Sequence
  Description of Artificial Sequence: Synthetic oligonucleotide
ccagguguaugccaugaag

SEQ ID NO: 3894 - RNA, 19 nt, Artificial Sequence
  Description of Artificial Sequence: Synthetic oligonucleotide
cagguguaugccaugaaga

SEQ ID NO: 3895 - RNA, 19 nt, Artificial Sequence
  Description of Artificial Sequence: Synthetic oligonucleotide
agguguaugccaugaagau

SEQ ID NO: 3896 - RNA, 19 nt, Artificial Sequence
  Description of Artificial Sequence: Synthetic oligonucleotide
gguguaugccaugaagauc

SEQ ID NO: 3897 - RNA, 19 nt, Artificial Sequence
  Description of Artificial Sequence: Synthetic oligonucleotide
guguaugccaugaagauca

SEQ ID NO: 3898 - RNA, 19 nt, Artificial Sequence
  Description of Artificial Sequence: Synthetic oligonucleotide
uguaugccaugaagaucau

SEQ ID NO: 3899 - RNA, 19 nt, Artificial Sequence
  Description of Artificial Sequence: Synthetic oligonucleotide
guaugccaugaagaucaug

SEQ ID NO: 3900 - RNA, 19 nt, Artificial Sequence
  Description of Artificial Sequence: Synthetic oligonucleotide
uaugccaugaagaucauga

SEQ ID NO: 3901 - RNA, 19 nt, Artificial Sequence
  Description of Artificial Sequence: Synthetic oligonucleotide
augccaugaagaucaugaa

SEQ ID NO: 3902 - RNA, 19 nt, Artificial Sequence
  Description of Artificial Sequence: Synthetic oligonucleotide
ugccaugaagaucaugaac

SEQ ID NO: 3903 - RNA, 19 nt, Artificial Sequence
  Description of Artificial Sequence: Synthetic oligonucleotide
gccaugaagaucaugaaca

SEQ ID NO: 3904 - RNA, 19 nt, Artificial Sequence
  Description of Artificial Sequence: Synthetic oligonucleotide
ccaugaagaucaugaacaa

SEQ ID NO: 3905 - RNA, 19 nt, Artificial Sequence
  Description of Artificial Sequence: Synthetic oligonucleotide
caugaagaucaugaacaag

SEQ ID NO: 3906 - RNA, 19 nt, Artificial Sequence
  Description of Artificial Sequence: Synthetic oligonucleotide
augaagaucaugaacaagu

SEQ ID NO: 3907 - RNA, 19 nt, Artificial Sequence
  Description of Artificial Sequence: Synthetic oligonucleotide
ugaagaucaugaacaagug

SEQ ID NO: 3908 - RNA, 19 nt, Artificial Sequence
  Description of Artificial Sequence: Synthetic oligonucleotide
gaagaucaugaacaagugg

SEQ ID NO: 3909 - RNA, 19 nt, Artificial Sequence
  Description of Artificial Sequence: Synthetic oligonucleotide
aagaucaugaacaaguggg

SEQ ID NO: 3910 - RNA, 19 nt, Artificial Sequence
  Description of Artificial Sequence: Synthetic oligonucleotide
agaucaugaacaaguggga

SEQ ID NO: 3911 - RNA, 19 nt, Artificial Sequence
  Description of Artificial Sequence: Synthetic oligonucleotide
gaucaugaacaagugggac

SEQ ID NO: 3912 - RNA, 19 nt, Artificial Sequence
  Description of Artificial Sequence: Synthetic oligonucleotide
aucaugaacaagugggaca

SEQ ID NO: 3913 - RNA, 19 nt, Artificial Sequence
  Description of Artificial Sequence: Synthetic oligonucleotide
ucaugaacaagugggacau

SEQ ID NO: 3914 - RNA, 19 nt, Artificial Sequence
  Description of Artificial Sequence: Synthetic oligonucleotide
caugaacaagugggacaug

SEQ ID NO: 3915 - RNA, 19 nt, Artificial Sequence
  Description of Artificial Sequence: Synthetic oligonucleotide
augaacaagugggacaugc

SEQ ID NO: 3916 - RNA, 19 nt, Artificial Sequence
  Description of Artificial Sequence: Synthetic oligonucleotide
ugaacaagugggacaugcu

SEQ ID NO: 3917 - RNA, 19 nt, Artificial Sequence
  Description of Artificial Sequence: Synthetic oligonucleotide
gaacaagugggacaugcug

SEQ ID NO: 3918 - RNA, 19 nt, Artificial Sequence
  Description of Artificial Sequence: Synthetic oligonucleotide
aacaagugggacaugcuga

SEQ ID NO: 3919 - RNA, 19 nt, Artificial Sequence
  Description of Artificial Sequence: Synthetic oligonucleotide
acaagugggacaugcugaa

SEQ ID NO: 3920 - RNA, 19 nt, Artificial Sequence
  Description of Artificial Sequence: Synthetic oligonucleotide
caagugggacaugcugaag

SEQ ID NO: 3921 - RNA, 19 nt, Artificial Sequence
  Description of Artificial Sequence: Synthetic oligonucleotide
aagugggacaugcugaaga

SEQ ID NO: 3922 - RNA, 19 nt, Artificial Sequence
  Description of Artificial Sequence: Synthetic oligonucleotide
agugggacaugcugaagag

SEQ ID NO: 3923 - RNA, 19 nt, Artificial Sequence
  Description of Artificial Sequence: Synthetic oligonucleotide
gugggacaugcugaagagg

SEQ ID NO: 3924 - RNA, 19 nt, Artificial Sequence
  Description of Artificial Sequence: Synthetic oligonucleotide
ugggacaugcugaagaggg

SEQ ID NO: 3925 - RNA, 19 nt, Artificial Sequence
  Description of Artificial Sequence: Synthetic oligonucleotide
gggacaugcugaagagggg

SEQ ID NO: 3926 - RNA, 19 nt, Artificial Sequence
  Description of Artificial Sequence: Synthetic oligonucleotide
ggacaugcugaagaggggc

SEQ ID NO: 3927 - RNA, 19 nt, Artificial Sequence
  Description of Artificial Sequence: Synthetic oligonucleotide
gacaugcugaagaggggcg

SEQ ID NO: 3928 - RNA, 19 nt, Artificial Sequence
  Description of Artificial Sequence: Synthetic oligonucleotide
acaugcugaagaggggcga

SEQ ID NO: 3929 - RNA, 19 nt, Artificial Sequence
  Description of Artificial Sequence: Synthetic oligonucleotide
caugcugaagaggggcgag

SEQ ID NO: 3930 - RNA, 19 nt, Artificial Sequence
  Description of Artificial Sequence: Synthetic oligonucleotide
augcugaagaggggcgagg

SEQ ID NO: 3931 - RNA, 19 nt, Artificial Sequence
  Description of Artificial Sequence: Synthetic oligonucleotide
ugcugaagaggggcgaggu

SEQ ID NO: 3932 - RNA, 19 nt, Artificial Sequence
  Description of Artificial Sequence: Synthetic oligonucleotide
gcugaagaggggcgaggug

SEQ ID NO: 3933 - RNA, 19 nt, Artificial Sequence
  Description of Artificial Sequence: Synthetic oligonucleotide
cugaagaggggcgaggugu

SEQ ID NO: 3934 - RNA, 19 nt, Artificial Sequence
  Description of Artificial Sequence: Synthetic oligonucleotide
ugaagaggggcgagguguc

SEQ ID NO: 3935 - RNA, 19 nt, Artificial Sequence
  Description of Artificial Sequence: Synthetic oligonucleotide
gaagaggggcgaggugucg

SEQ ID NO: 3936 - RNA, 19 nt, Artificial Sequence
  Description of Artificial Sequence: Synthetic oligonucleotide
aagaggggcgaggugucgu

SEQ ID NO: 3937 - RNA, 19 nt, Artificial Sequence
  Description of Artificial Sequence: Synthetic oligonucleotide
agaggggcgaggugucgug

SEQ ID NO: 3938 - RNA, 19 nt, Artificial Sequence
  Description of Artificial Sequence: Synthetic oligonucleotide
gaggggcgaggugucgugc

SEQ ID NO: 3939 - RNA, 19 nt, Artificial Sequence
  Description of Artificial Sequence: Synthetic oligonucleotide
aggggcgaggugucgugcu

SEQ ID NO: 3940 - RNA, 19 nt, Artificial Sequence
  Description of Artificial Sequence: Synthetic oligonucleotide
ggggcgaggugucgugcuu

SEQ ID NO: 3941 - RNA, 19 nt, Artificial Sequence
  Description of Artificial Sequence: Synthetic oligonucleotide
gggcgaggugucgugcuuc

SEQ ID NO: 3942 - RNA, 19 nt, Artificial Sequence
  Description of Artificial Sequence: Synthetic oligonucleotide
ggcgaggugucgugcuucc

SEQ ID NO: 3943 - RNA, 19 nt, Artificial Sequence
  Description of Artificial Sequence: Synthetic oligonucleotide
gcgaggugucgugcuuccg

SEQ ID NO: 3944 - RNA, 19 nt, Artificial Sequence
  Description of Artificial Sequence: Synthetic oligonucleotide
cgaggugucgugcuuccgu

SEQ ID NO: 3945 - RNA, 19 nt, Artificial Sequence
  Description of Artificial Sequence: Synthetic oligonucleotide
gaggugucgugcuuccgug

SEQ ID NO: 3946 - RNA, 19 nt, Artificial Sequence
  Description of Artificial Sequence: Synthetic oligonucleotide
aggugucgugcuuccguga

SEQ ID NO: 3947 - RNA, 19 nt, Artificial Sequence
  Description of Artificial Sequence: Synthetic oligonucleotide
ggugucgugcuuccgugag

SEQ ID NO: 3948 - RNA, 19 nt, Artificial Sequence
  Description of Artificial Sequence: Synthetic oligonucleotide
gugucgugcuuccgugagg

SEQ ID NO: 3949 - RNA, 19 nt, Artificial Sequence
  Description of Artificial Sequence: Synthetic oligonucleotide
ugucgugcuuccgugagga

SEQ ID NO: 3950 - RNA, 19 nt, Artificial Sequence
  Description of Artificial Sequence: Synthetic oligonucleotide
gucgugcuuccgugaggag

SEQ ID NO: 3951 - RNA, 19 nt, Artificial Sequence
  Description of Artificial Sequence: Synthetic oligonucleotide
ucgugcuuccgugaggaga

SEQ ID NO: 3952 - RNA, 19 nt, Artificial Sequence
  Description of Artificial Sequence: Synthetic oligonucleotide
cgugcuuccgugaggagag

SEQ ID NO: 3953 - RNA, 19 nt, Artificial Sequence
  Description of Artificial Sequence: Synthetic oligonucleotide
gugcuuccgugaggagagg

SEQ ID NO: 3954 - RNA, 19 nt, Artificial Sequence
  Description of Artificial Sequence: Synthetic oligonucleotide
ugcuuccgugaggagaggg

SEQ ID NO: 3955 - RNA, 19 nt, Artificial Sequence
  Description of Artificial Sequence: Synthetic oligonucleotide
gcuuccgugaggagaggga

SEQ ID NO: 3956 - RNA, 19 nt, Artificial Sequence
  Description of Artificial Sequence: Synthetic oligonucleotide
cuuccgugaggagagggac

SEQ ID NO: 3957 - RNA, 19 nt, Artificial Sequence
  Description of Artificial Sequence: Synthetic oligonucleotide
uuccgugaggagagggacg

SEQ ID NO: 3958 - RNA, 19 nt, Artificial Sequence
  Description of Artificial Sequence: Synthetic oligonucleotide
uccgugaggagagggacgu

SEQ ID NO: 3959 - RNA, 19 nt, Artificial Sequence
  Description of Artificial Sequence: Synthetic oligonucleotide
ccgugaggagagggacgug

SEQ ID NO: 3960 - RNA, 19 nt, Artificial Sequence
  Description of Artificial Sequence: Synthetic oligonucleotide
cgugaggagagggacgugu

SEQ ID NO: 3961 - RNA, 19 nt, Artificial Sequence
  Description of Artificial Sequence: Synthetic oligonucleotide
gugaggagagggacguguu

SEQ ID NO: 3962 - RNA, 19 nt, Artificial Sequence
  Description of Artificial Sequence: Synthetic oligonucleotide
ugaggagagggacguguug

SEQ ID NO: 3963 - RNA, 19 nt, Artificial Sequence
  Description of Artificial Sequence: Synthetic oligonucleotide
gaggagagggacguguugg

SEQ ID NO: 3964 - RNA, 19 nt, Artificial Sequence
  Description of Artificial Sequence: Synthetic oligonucleotide
aggagagggacguguuggu

SEQ ID NO: 3965 - RNA, 19 nt, Artificial Sequence
  Description of Artificial Sequence: Synthetic oligonucleotide
ggagagggacguguuggug

SEQ ID NO: 3966 - RNA, 19 nt, Artificial Sequence
  Description of Artificial Sequence: Synthetic oligonucleotide
gagagggacguguugguga

SEQ ID NO: 3967 - RNA, 19 nt, Artificial Sequence
  Description of Artificial Sequence: Synthetic oligonucleotide
agagggacguguuggugaa

SEQ ID NO: 3968 - RNA, 19 nt, Artificial Sequence
  Description of Artificial Sequence: Synthetic oligonucleotide
gagggacguguuggugaau

SEQ ID NO: 3969 - RNA, 19 nt, Artificial Sequence
  Description of Artificial Sequence: Synthetic oligonucleotide
agggacguguuggugaaug

SEQ ID NO: 3970 - RNA, 19 nt, Artificial Sequence
  Description of Artificial Sequence: Synthetic oligonucleotide
gggacguguuggugaaugg

SEQ ID NO: 3971 - RNA, 19 nt, Artificial Sequence
  Description of Artificial Sequence: Synthetic oligonucleotide
ggacguguuggugaauggg

SEQ ID NO: 3972 - RNA, 19 nt, Artificial Sequence
  Description of Artificial Sequence: Synthetic oligonucleotide
gacguguuggugaaugggg

SEQ ID NO: 3973 - RNA, 19 nt, Artificial Sequence
  Description of Artificial Sequence: Synthetic oligonucleotide
acguguuggugaaugggga

SEQ ID NO: 3974 - RNA, 19 nt, Artificial Sequence
  Description of Artificial Sequence: Synthetic oligonucleotide
cguguuggugaauggggac

SEQ ID NO: 3975 - RNA, 19 nt, Artificial Sequence
  Description of Artificial Sequence: Synthetic oligonucleotide
guguuggugaauggggacc

SEQ ID NO: 3976 - RNA, 19 nt, Artificial Sequence
  Description of Artificial Sequence: Synthetic oligonucleotide
uguuggugaauggggaccg

SEQ ID NO: 3977 - RNA, 19 nt, Artificial Sequence
  Description of Artificial Sequence: Synthetic oligonucleotide
guuggugaauggggaccgg

SEQ ID NO: 3978 - RNA, 19 nt, Artificial Sequence
  Description of Artificial Sequence: Synthetic oligonucleotide
uuggugaauggggaccggc

SEQ ID NO: 3979 - RNA, 19 nt, Artificial Sequence
  Description of Artificial Sequence: Synthetic oligonucleotide
uggugaauggggaccggcg

SEQ ID NO: 3980 - RNA, 19 nt, Artificial Sequence
  Description of Artificial Sequence: Synthetic oligonucleotide
ggugaauggggaccggcgg

SEQ ID NO: 3981 - RNA, 19 nt, Artificial Sequence
  Description of Artificial Sequence: Synthetic oligonucleotide
gugaauggggaccggcggu

SEQ ID NO: 3982 - RNA, 19 nt, Artificial Sequence
  Description of Artificial Sequence: Synthetic oligonucleotide
ugaauggggaccggcggug

SEQ ID NO: 3983 - RNA, 19 nt, Artificial Sequence
  Description of Artificial Sequence: Synthetic oligonucleotide
gaauggggaccggcggugg

SEQ ID NO: 3984 - RNA, 19 nt, Artificial Sequence
  Description of Artificial Sequence: Synthetic oligonucleotide
aauggggaccggcggugga

SEQ ID NO: 3985 - RNA, 19 nt, Artificial Sequence
  Description of Artificial Sequence: Synthetic oligonucleotide
auggggaccggcgguggau

SEQ ID NO: 3986 - RNA, 19 nt, Artificial Sequence
  Description of Artificial Sequence: Synthetic oligonucleotide
uggggaccggcgguggauc

SEQ ID NO: 3987 - RNA, 19 nt, Artificial Sequence
  Description of Artificial Sequence: Synthetic oligonucleotide
ggggaccggcgguggauca

SEQ ID NO: 3988 - RNA, 19 nt, Artificial Sequence
  Description of Artificial Sequence: Synthetic oligonucleotide
gggaccggcgguggaucac

SEQ ID NO: 3989 - RNA, 19 nt, Artificial Sequence
  Description of Artificial Sequence: Synthetic oligonucleotide
ggaccggcgguggaucacg

SEQ ID NO: 3990 - RNA, 19 nt, Artificial Sequence
  Description of Artificial Sequence: Synthetic oligonucleotide
gaccggcgguggaucacgc

SEQ ID NO: 3991 - RNA, 19 nt, Artificial Sequence
  Description of Artificial Sequence: Synthetic oligonucleotide
accggcgguggaucacgca

SEQ ID NO: 3992 - RNA, 19 nt, Artificial Sequence
  Description of Artificial Sequence: Synthetic oligonucleotide
ccggcgguggaucacgcag

SEQ ID NO: 3993 - RNA, 19 nt, Artificial Sequence
  Description of Artificial Sequence: Synthetic oligonucleotide
cggcgguggaucacgcagc

SEQ ID NO: 3994 - RNA, 19 nt, Artificial Sequence
  Description of Artificial Sequence: Synthetic oligonucleotide
ggcgguggaucacgcagcu

SEQ ID NO: 3995 - RNA, 19 nt, Artificial Sequence
  Description of Artificial Sequence: Synthetic oligonucleotide
gcgguggaucacgcagcug

SEQ ID NO: 3996 - RNA, 19 nt, Artificial Sequence
  Description of Artificial Sequence: Synthetic oligonucleotide
cgguggaucacgcagcugc

SEQ ID NO: 3997 - RNA, 19 nt, Artificial Sequence
  Description of Artificial Sequence: Synthetic oligonucleotide
gguggaucacgcagcugca

SEQ ID NO: 3998 - RNA, 19 nt, Artificial Sequence
  Description of Artificial Sequence: Synthetic oligonucleotide
guggaucacgcagcugcac

SEQ ID NO: 3999 - RNA, 19 nt, Artificial Sequence
  Description of Artificial Sequence: Synthetic oligonucleotide
uggaucacgcagcugcacu

SEQ ID NO: 4000 - RNA, 19 nt, Artificial Sequence
  Description of Artificial Sequence: Synthetic oligonucleotide
ggaucacgcagcugcacuu

SEQ ID NO: 4001 - RNA, 19 nt, Artificial Sequence
  Description of Artificial Sequence: Synthetic oligonucleotide
gaucacgcagcugcacuuc

SEQ ID NO: 4002 - RNA, 19 nt, Artificial Sequence
  Description of Artificial Sequence: Synthetic oligonucleotide
aucacgcagcugcacuucg

SEQ ID NO: 4003 - RNA, 19 nt, Artificial Sequence
  Description of Artificial Sequence: Synthetic oligonucleotide
ucacgcagcugcacuucgc

SEQ ID NO: 4004 - RNA, 19 nt, Artificial Sequence
  Description of Artificial Sequence: Synthetic oligonucleotide
cacgcagcugcacuucgcc

SEQ ID NO: 4005 - RNA, 19 nt, Artificial Sequence
  Description of Artificial Sequence: Synthetic oligonucleotide
acgcagcugcacuucgccu

SEQ ID NO: 4006 - RNA, 19 nt, Artificial Sequence
  Description of Artificial Sequence: Synthetic oligonucleotide
cgcagcugcacuucgccuu

SEQ ID NO: 4007 - RNA, 19 nt, Artificial Sequence
  Description of Artificial Sequence: Synthetic oligonucleotide
gcagcugcacuucgccuuc

SEQ ID NO: 4008 - RNA, 19 nt, Artificial Sequence
  Description of Artificial Sequence: Synthetic oligonucleotide
cagcugcacuucgccuucc

SEQ ID NO: 4009 - RNA, 19 nt, Artificial Sequence
  Description of Artificial Sequence: Synthetic oligonucleotide
agcugcacuucgccuucca

SEQ ID NO: 4010 - RNA, 19 nt, Artificial Sequence
  Description of Artificial Sequence: Synthetic oligonucleotide
gcugcacuucgccuuccag

SEQ ID NO: 4011 - RNA, 19 nt, Artificial Sequence
  Description of Artificial Sequence: Synthetic oligonucleotide
cugcacuucgccuuccagg

SEQ ID NO: 4012 - RNA, 19 nt, Artificial Sequence
  Description of Artificial Sequence: Synthetic oligonucleotide
ugcacuucgccuuccagga

SEQ ID NO: 4013 - RNA, 19 nt, Artificial Sequence
  Description of Artificial Sequence: Synthetic oligonucleotide
gcacuucgccuuccaggau

SEQ ID NO: 4014 - RNA, 19 nt, Artificial Sequence
  Description of Artificial Sequence: Synthetic oligonucleotide
cacuucgccuuccaggaug

SEQ ID NO: 4015 - RNA, 19 nt, Artificial Sequence
  Description of Artificial Sequence: Synthetic oligonucleotide
acuucgccuuccaggauga

SEQ ID NO: 4016 - RNA, 19 nt, Artificial Sequence
  Description of Artificial Sequence: Synthetic oligonucleotide
cuucgccuuccaggaugag

SEQ ID NO: 4017 - RNA, 19 nt, Artificial Sequence
  Description of Artificial Sequence: Synthetic oligonucleotide
uucgccuuccaggaugaga

SEQ ID NO: 4018 - RNA, 19 nt, Artificial Sequence
  Description of Artificial Sequence: Synthetic oligonucleotide
ucgccuuccaggaugagaa

SEQ ID NO: 4019 - RNA, 19 nt, Artificial Sequence
  Description of Artificial Sequence: Synthetic oligonucleotide
cgccuuccaggaugagaac

SEQ ID NO: 4020 - RNA, 19 nt, Artificial Sequence
  Description of Artificial Sequence: Synthetic oligonucleotide
gccuuccaggaugagaacu

SEQ ID NO: 4021 - RNA, 19 nt, Artificial Sequence
  Description of Artificial Sequence: Synthetic oligonucleotide
ccuuccaggaugagaacua

SEQ ID NO: 4022 - RNA, 19 nt, Artificial Sequence
  Description of Artificial Sequence: Synthetic oligonucleotide
cuuccaggaugagaacuac

SEQ ID NO: 4023 - RNA, 19 nt, Artificial Sequence
  Description of Artificial Sequence: Synthetic oligonucleotide
uuccaggaugagaacuacc

SEQ ID NO: 4024 - RNA, 19 nt, Artificial Sequence
  Description of Artificial Sequence: Synthetic oligonucleotide
uccaggaugagaacuaccu

SEQ ID NO: 4025 - RNA, 19 nt, Artificial Sequence
  Description of Artificial Sequence: Synthetic oligonucleotide
ccaggaugagaacuaccug

SEQ ID NO: 4026 - RNA, 19 nt, Artificial Sequence
  Description of Artificial Sequence: Synthetic oligonucleotide
caggaugagaacuaccugu

SEQ ID NO: 4027 - RNA, 19 nt, Artificial Sequence
  Description of Artificial Sequence: Synthetic oligonucleotide
aggaugagaacuaccugua

SEQ ID NO: 4028 - RNA, 19 nt, Artificial Sequence
  Description of Artificial Sequence: Synthetic oligonucleotide
ggaugagaacuaccuguac

SEQ ID NO: 4029 - RNA, 19 nt, Artificial Sequence
  Description of Artificial Sequence: Synthetic oligonucleotide
gaugagaacuaccuguacc

SEQ ID NO: 4030 - RNA, 19 nt, Artificial Sequence
  Description of Artificial Sequence: Synthetic oligonucleotide
augagaacuaccuguaccu

SEQ ID NO: 4031 - RNA, 19 nt, Artificial Sequence
  Description of Artificial Sequence: Synthetic oligonucleotide
ugagaacuaccuguaccug

SEQ ID NO: 4032 - RNA, 19 nt, Artificial Sequence
  Description of Artificial Sequence: Synthetic oligonucleotide
gagaacuaccuguaccugg

SEQ ID NO: 4033 - RNA, 19 nt, Artificial Sequence
  Description of Artificial Sequence: Synthetic oligonucleotide
agaacuaccuguaccuggu

SEQ ID NO: 4034 - RNA, 19 nt, Artificial Sequence
  Description of Artificial Sequence: Synthetic oligonucleotide
gaacuaccuguaccugguc

SEQ ID NO: 4035 - RNA, 19 nt, Artificial Sequence
  Description of Artificial Sequence: Synthetic oligonucleotide
aacuaccuguaccugguca

SEQ ID NO: 4036 - RNA, 19 nt, Artificial Sequence
  Description of Artificial Sequence: Synthetic oligonucleotide
acuaccuguaccuggucau

SEQ ID NO: 4037 - RNA, 19 nt, Artificial Sequence
  Description of Artificial Sequence: Synthetic oligonucleotide
cuaccuguaccuggucaug

SEQ ID NO: 4038 - RNA, 19 nt, Artificial Sequence
  Description of Artificial Sequence: Synthetic oligonucleotide
uaccuguaccuggucaugg

SEQ ID NO: 4039 - RNA, 19 nt, Artificial Sequence
  Description of Artificial Sequence: Synthetic oligonucleotide
accuguaccuggucaugga

SEQ ID NO: 4040 - RNA, 19 nt, Artificial Sequence
  Description of Artificial Sequence: Synthetic oligonucleotide
ccuguaccuggucauggag

SEQ ID NO: 4041 - RNA, 19 nt, Artificial Sequence
  Description of Artificial Sequence: Synthetic oligonucleotide
cuguaccuggucauggagu

SEQ ID NO: 4042 - RNA, 19 nt, Artificial Sequence
  Description of Artificial Sequence: Synthetic oligonucleotide
uguaccuggucauggagua

SEQ ID NO: 4043 - RNA, 19 nt, Artificial Sequence
  Description of Artificial Sequence: Synthetic oligonucleotide
guaccuggucauggaguau

SEQ ID NO: 4044 - RNA, 19 nt, Artificial Sequence
  Description of Artificial Sequence: Synthetic oligonucleotide
uaccuggucauggaguauu

SEQ ID NO: 4045 - RNA, 19 nt, Artificial Sequence
  Description of Artificial Sequence: Synthetic oligonucleotide
accuggucauggaguauua

SEQ ID NO: 4046 - RNA, 19 nt, Artificial Sequence
  Description of Artificial Sequence: Synthetic oligonucleotide
ccuggucauggaguauuac

SEQ ID NO: 4047 - RNA, 19 nt, Artificial Sequence
  Description of Artificial Sequence: Synthetic oligonucleotide
cuggucauggaguauuacg

SEQ ID NO: 4048 - RNA, 19 nt, Artificial Sequence
  Description of Artificial Sequence: Synthetic oligonucleotide
uggucauggaguauuacgu

SEQ ID NO: 4049 - RNA, 19 nt, Artificial Sequence
  Description of Artificial Sequence: Synthetic oligonucleotide
ggucauggaguauuacgug

SEQ ID NO: 4050 - RNA, 19 nt, Artificial Sequence
  Description of Artificial Sequence: Synthetic oligonucleotide
gucauggaguauuacgugg

SEQ ID NO: 4051 - RNA, 19 nt, Artificial Sequence
  Description of Artificial Sequence: Synthetic oligonucleotide
ucauggaguauuacguggg

SEQ ID NO: 4052 - RNA, 19 nt, Artificial Sequence
  Description of Artificial Sequence: Synthetic oligonucleotide
cauggaguauuacgugggc

SEQ ID NO: 4053 - RNA, 19 nt, Artificial Sequence
  Description of Artificial Sequence: Synthetic oligonucleotide
auggaguauuacgugggcg

SEQ ID NO: 4054 - RNA, 19 nt, Artificial Sequence
  Description of Artificial Sequence: Synthetic oligonucleotide
uggaguauuacgugggcgg

SEQ ID NO: 4055 - RNA, 19 nt, Artificial Sequence
  Description of Artificial Sequence: Synthetic oligonucleotide
ggaguauuacgugggcggg

SEQ ID NO: 4056 - RNA, 19 nt, Artificial Sequence
  Description of Artificial Sequence: Synthetic oligonucleotide
gaguauuacgugggcgggg

SEQ ID NO: 4057 - RNA, 19 nt, Artificial Sequence
  Description of Artificial Sequence: Synthetic oligonucleotide
aguauuacgugggcgggga

SEQ ID NO: 4058 - RNA, 19 nt, Artificial Sequence
  Description of Artificial Sequence: Synthetic oligonucleotide
guauuacgugggcggggac

SEQ ID NO: 4059 - RNA, 19 nt, Artificial Sequence
  Description of Artificial Sequence: Synthetic oligonucleotide
uauuacgugggcggggacc

SEQ ID NO: 4060 - RNA, 19 nt, Artificial Sequence
  Description of Artificial Sequence: Synthetic oligonucleotide
auuacgugggcggggaccu

SEQ ID NO: 4061 - RNA, 19 nt, Artificial Sequence
  Description of Artificial Sequence: Synthetic oligonucleotide
uuacgugggcggggaccug

SEQ ID NO: 4062 - RNA, 19 nt, Artificial Sequence
  Description of Artificial Sequence: Synthetic oligonucleotide
uacgugggcggggaccugc

SEQ ID NO: 4063 - RNA, 19 nt, Artificial Sequence
  Description of Artificial Sequence: Synthetic oligonucleotide
acgugggcggggaccugcu

SEQ ID NO: 4064 - RNA, 19 nt, Artificial Sequence
  Description of Artificial Sequence: Synthetic oligonucleotide
cgugggcggggaccugcug

SEQ ID NO: 4065 - RNA, 19 nt, Artificial Sequence
  Description of Artificial Sequence: Synthetic oligonucleotide
gugggcggggaccugcuga

SEQ ID NO: 4066 - RNA, 19 nt, Artificial Sequence
  Description of Artificial Sequence: Synthetic oligonucleotide
ugggcggggaccugcugac

SEQ ID NO: 4067 - RNA, 19 nt, Artificial Sequence
  Description of Artificial Sequence: Synthetic oligonucleotide
gggcggggaccugcugaca

SEQ ID NO: 4068 - RNA, 19 nt, Artificial Sequence
  Description of Artificial Sequence: Synthetic oligonucleotide
ggcggggaccugcugacac

SEQ ID NO: 4069 - RNA, 19 nt, Artificial Sequence
  Description of Artificial Sequence: Synthetic oligonucleotide
gcggggaccugcugacacu

SEQ ID NO: 4070 - RNA, 19 nt, Artificial Sequence
  Description of Artificial Sequence: Synthetic oligonucleotide
cggggaccugcugacacug

SEQ ID NO: 4071 - RNA, 19 nt, Artificial Sequence
  Description of Artificial Sequence: Synthetic oligonucleotide
ggggaccugcugacacugc

SEQ ID NO: 4072 - RNA, 19 nt, Artificial Sequence
  Description of Artificial Sequence: Synthetic oligonucleotide
gggaccugcugacacugcu

SEQ ID NO: 4073 - RNA, 19 nt, Artificial Sequence
  Description of Artificial Sequence: Synthetic oligonucleotide
ggaccugcugacacugcug

SEQ ID NO: 4074 - RNA, 19 nt, Artificial Sequence
  Description of Artificial Sequence: Synthetic oligonucleotide
gaccugcugacacugcuga

SEQ ID NO: 4075 - RNA, 19 nt, Artificial Sequence
  Description of Artificial Sequence: Synthetic oligonucleotide
accugcugacacugcugag

SEQ ID NO: 4076 - RNA, 19 nt, Artificial Sequence
  Description of Artificial Sequence: Synthetic oligonucleotide
ccugcugacacugcugagc

SEQ ID NO: 4077 - RNA, 19 nt, Artificial Sequence
  Description of Artificial Sequence: Synthetic oligonucleotide
cugcugacacugcugagca

SEQ ID NO: 4078 - RNA, 19 nt, Artificial Sequence
  Description of Artificial Sequence: Synthetic oligonucleotide
ugcugacacugcugagcaa

SEQ ID NO: 4079 - RNA, 19 nt, Artificial Sequence
  Description of Artificial Sequence: Synthetic oligonucleotide
gcugacacugcugagcaag

SEQ ID NO: 4080 - RNA, 19 nt, Artificial Sequence
  Description of Artificial Sequence: Synthetic oligonucleotide
cugacacugcugagcaagu

SEQ ID NO: 4081 - RNA, 19 nt, Artificial Sequence
  Description of Artificial Sequence: Synthetic oligonucleotide
ugacacugcugagcaaguu

SEQ ID NO: 4082 - RNA, 19 nt, Artificial Sequence
  Description of Artificial Sequence: Synthetic oligonucleotide
gacacugcugagcaaguuu

SEQ ID NO: 4083 - RNA, 19 nt, Artificial Sequence
  Description of Artificial Sequence: Synthetic oligonucleotide
acacugcugagcaaguuug

SEQ ID NO: 4084 - RNA, 19 nt, Artificial Sequence
  Description of Artificial Sequence: Synthetic oligonucleotide
cacugcugagcaaguuugg

SEQ ID NO: 4085 - RNA, 19 nt, Artificial Sequence
  Description of Artificial Sequence: Synthetic oligonucleotide
acugcugagcaaguuuggg

SEQ ID NO: 4086 - RNA, 19 nt, Artificial Sequence
  Description of Artificial Sequence: Synthetic oligonucleotide
cugcugagcaaguuugggg

SEQ ID NO: 4087 - RNA, 19 nt, Artificial Sequence
  Description of Artificial Sequence: Synthetic oligonucleotide
ugcugagcaaguuugggga

SEQ ID NO: 4088 - RNA, 19 nt, Artificial Sequence
  Description of Artificial Sequence: Synthetic oligonucleotide
gcugagcaaguuuggggag

SEQ ID NO: 4089 - RNA, 19 nt, Artificial Sequence
  Description of Artificial Sequence: Synthetic oligonucleotide
cugagcaaguuuggggagc

SEQ ID NO: 4090 - RNA, 19 nt, Artificial Sequence
  Description of Artificial Sequence: Synthetic oligonucleotide
ugagcaaguuuggggagcg

SEQ ID NO: 4091 - RNA, 19 nt, Artificial Sequence
  Description of Artificial Sequence: Synthetic oligonucleotide
gagcaaguuuggggagcgg

SEQ ID NO: 4092 - RNA, 19 nt, Artificial Sequence
  Description of Artificial Sequence: Synthetic oligonucleotide
agcaaguuuggggagcgga

SEQ ID NO: 4093 - RNA, 19 nt, Artificial Sequence
  Description of Artificial Sequence: Synthetic oligonucleotide
gcaaguuuggggagcggau

SEQ ID NO: 4094 - RNA, 19 nt, Artificial Sequence
  Description of Artificial Sequence: Synthetic oligonucleotide
caaguuuggggagcggauu

SEQ ID NO: 4095 - RNA, 19 nt, Artificial Sequence
  Description of Artificial Sequence: Synthetic oligonucleotide
aaguuuggggagcggauuc

SEQ ID NO: 4096 - RNA, 19 nt, Artificial Sequence
  Description of Artificial Sequence: Synthetic oligonucleotide
aguuuggggagcggauucc

SEQ ID NO: 4097 - RNA, 19 nt, Artificial Sequence
  Description of Artificial Sequence: Synthetic oligonucleotide
guuuggggagcggauuccg

SEQ ID NO: 4098 - RNA, 19 nt, Artificial Sequence
  Description of Artificial Sequence: Synthetic oligonucleotide
uuuggggagcggauuccgg

SEQ ID NO: 4099 - RNA, 19 nt, Artificial Sequence
  Description of Artificial Sequence: Synthetic oligonucleotide
uuggggagcggauuccggc

SEQ ID NO: 4100 - RNA, 19 nt, Artificial Sequence
  Description of Artificial Sequence: Synthetic oligonucleotide
uggggagcggauuccggcc

SEQ ID NO: 4101 - RNA, 19 nt, Artificial Sequence
  Description of Artificial Sequence: Synthetic oligonucleotide
ggggagcggauuccggccg

SEQ ID NO: 4102 - RNA, 19 nt, Artificial Sequence
  Description of Artificial Sequence: Synthetic oligonucleotide
gggagcggauuccggccga

SEQ ID NO: 4103 - RNA, 19 nt, Artificial Sequence
  Description of Artificial Sequence: Synthetic oligonucleotide
ggagcggauuccggccgag

SEQ ID NO: 4104 - RNA, 19 nt, Artificial Sequence
  Description of Artificial Sequence: Synthetic oligonucleotide
gagcggauuccggccgaga

SEQ ID NO: 4105 - RNA, 19 nt, Artificial Sequence
  Description of Artificial Sequence: Synthetic oligonucleotide
agcggauuccggccgagau

SEQ ID NO: 4106 - RNA, 19 nt, Artificial Sequence
  Description of Artificial Sequence: Synthetic oligonucleotide
gcggauuccggccgagaug

SEQ ID NO: 4107 - RNA, 19 nt, Artificial Sequence
  Description of Artificial Sequence: Synthetic oligonucleotide
cggauuccggccgagaugg

SEQ ID NO: 4108 - RNA, 19 nt, Artificial Sequence
  Description of Artificial Sequence: Synthetic oligonucleotide
ggauuccggccgagauggc

SEQ ID NO: 4109 - RNA, 19 nt, Artificial Sequence
  Description of Artificial Sequence: Synthetic oligonucleotide
gauuccggccgagauggcg

SEQ ID NO: 4110 - RNA, 19 nt, Artificial Sequence
  Description of Artificial Sequence: Synthetic oligonucleotide
auuccggccgagauggcgc

SEQ ID NO: 4111 - RNA, 19 nt, Artificial Sequence
  Description of Artificial Sequence: Synthetic oligonucleotide
uuccggccgagauggcgcg

SEQ ID NO: 4112 - RNA, 19 nt, Artificial Sequence
  Description of Artificial Sequence: Synthetic oligonucleotide
uccggccgagauggcgcgc

SEQ ID NO: 4113 - RNA, 19 nt, Artificial Sequence
  Description of Artificial Sequence: Synthetic oligonucleotide
ccggccgagauggcgcgcu

SEQ ID NO: 4114 - RNA, 19 nt, Artificial Sequence
  Description of Artificial Sequence: Synthetic oligonucleotide
cggccgagauggcgcgcuu

SEQ ID NO: 4115 - RNA, 19 nt, Artificial Sequence
  Description of Artificial Sequence: Synthetic oligonucleotide
ggccgagauggcgcgcuuc

SEQ ID NO: 4116 - RNA, 19 nt, Artificial Sequence
  Description of Artificial Sequence: Synthetic oligonucleotide
gccgagauggcgcgcuucu

SEQ ID NO: 4117 - RNA, 19 nt, Artificial Sequence
  Description of Artificial Sequence: Synthetic oligonucleotide
ccgagauggcgcgcuucua

SEQ ID NO: 4118 - RNA, 19 nt, Artificial Sequence
  Description of Artificial Sequence: Synthetic oligonucleotide
cgagauggcgcgcuucuac

SEQ ID NO: 4119 - RNA, 19 nt, Artificial Sequence
  Description of Artificial Sequence: Synthetic oligonucleotide
gagauggcgcgcuucuacc

SEQ ID NO: 4120 - RNA, 19 nt, Artificial Sequence
  Description of Artificial Sequence: Synthetic oligonucleotide
agauggcgcgcuucuaccu

SEQ ID NO: 4121 - RNA, 19 nt, Artificial Sequence
  Description of Artificial Sequence: Synthetic oligonucleotide
gauggcgcgcuucuaccug

SEQ ID NO: 4122 - RNA, 19 nt, Artificial Sequence
  Description of Artificial Sequence: Synthetic oligonucleotide
auggcgcgcuucuaccugg

SEQ ID NO: 4123 - RNA, 19 nt, Artificial Sequence
  Description of Artificial Sequence: Synthetic oligonucleotide
uggcgcgcuucuaccuggc

SEQ ID NO: 4124 - RNA, 19 nt, Artificial Sequence
  Description of Artificial Sequence: Synthetic oligonucleotide
ggcgcgcuucuaccuggcg

SEQ ID NO: 4125 - RNA, 19 nt, Artificial Sequence
  Description of Artificial Sequence: Synthetic oligonucleotide
gcgcgcuucuaccuggcgg

SEQ ID NO: 4126 - RNA, 19 nt, Artificial Sequence
  Description of Artificial Sequence: Synthetic oligonucleotide
cgcgcuucuaccuggcgga

SEQ ID NO: 4127 - RNA, 19 nt, Artificial Sequence
  Description of Artificial Sequence: Synthetic oligonucleotide
gcgcuucuaccuggcggag

SEQ ID NO: 4128 - RNA, 19 nt, Artificial Sequence
  Description of Artificial Sequence: Synthetic oligonucleotide
cgcuucuaccuggcggaga

SEQ ID NO: 4129 - RNA, 19 nt, Artificial Sequence
  Description of Artificial Sequence: Synthetic oligonucleotide
gcuucuaccuggcggagau

SEQ ID NO: 4130 - RNA, 19 nt, Artificial Sequence
  Description of Artificial Sequence: Synthetic oligonucleotide
cuucuaccuggcggagauu

SEQ ID NO: 4131 - RNA, 19 nt, Artificial Sequence
  Description of Artificial Sequence: Synthetic oligonucleotide
uucuaccuggcggagauug

SEQ ID NO: 4132 - RNA, 19 nt, Artificial Sequence
  Description of Artificial Sequence: Synthetic oligonucleotide
ucuaccuggcggagauugu

SEQ ID NO: 4133 - RNA, 19 nt, Artificial Sequence
  Description of Artificial Sequence: Synthetic oligonucleotide
cuaccuggcggagauuguc

SEQ ID NO: 4134 - RNA, 19 nt, Artificial Sequence
  Description of Artificial Sequence: Synthetic oligonucleotide
uaccuggcggagauuguca

SEQ ID NO: 4135 - RNA, 19 nt, Artificial Sequence
  Description of Artificial Sequence: Synthetic oligonucleotide
accuggcggagauugucau

SEQ ID NO: 4136 - RNA, 19 nt, Artificial Sequence
  Description of Artificial Sequence: Synthetic oligonucleotide
ccuggcggagauugucaug

SEQ ID NO: 4137 - RNA, 19 nt, Artificial Sequence
  Description of Artificial Sequence: Synthetic oligonucleotide
cuggcggagauugucaugg

SEQ ID NO: 4138 - RNA, 19 nt, Artificial Sequence
  Description of Artificial Sequence: Synthetic oligonucleotide
uggcggagauugucauggc

SEQ ID NO: 4139 - RNA, 19 nt, Artificial Sequence
  Description of Artificial Sequence: Synthetic oligonucleotide
ggcggagauugucauggcc

SEQ ID NO: 4140 - RNA, 19 nt, Artificial Sequence
  Description of Artificial Sequence: Synthetic oligonucleotide
gcggagauugucauggcca

SEQ ID NO: 4141 - RNA, 19 nt, Artificial Sequence
  Description of Artificial Sequence: Synthetic oligonucleotide
cggagauugucauggccau

SEQ ID NO: 4142 - RNA, 19 nt, Artificial Sequence
  Description of Artificial Sequence: Synthetic oligonucleotide
ggagauugucauggccaua

SEQ ID NO: 4143 - RNA, 19 nt, Artificial Sequence
  Description of Artificial Sequence: Synthetic oligonucleotide
gagauugucauggccauag

SEQ ID NO: 4144 - RNA, 19 nt, Artificial Sequence
  Description of Artificial Sequence: Synthetic oligonucleotide
agauugucauggccauaga

SEQ ID NO: 4145 - RNA, 19 nt, Artificial Sequence
  Description of Artificial Sequence: Synthetic oligonucleotide
gauugucauggccauagac

SEQ ID NO: 4146 - RNA, 19 nt, Artificial Sequence
  Description of Artificial Sequence: Synthetic oligonucleotide
auugucauggccauagacu

SEQ ID NO: 4147 - RNA, 19 nt, Artificial Sequence
  Description of Artificial Sequence: Synthetic oligonucleotide
uugucauggccauagacuc

SEQ ID NO: 4148 - RNA, 19 nt, Artificial Sequence
  Description of Artificial Sequence: Synthetic oligonucleotide
ugucauggccauagacucg

SEQ ID NO: 4149 - RNA, 19 nt, Artificial Sequence
  Description of Artificial Sequence: Synthetic oligonucleotide
gucauggccauagacucgg

SEQ ID NO: 4150 - RNA, 19 nt, Artificial Sequence
  Description of Artificial Sequence: Synthetic oligonucleotide
ucauggccauagacucggu

SEQ ID NO: 4151 - RNA, 19 nt, Artificial Sequence
  Description of Artificial Sequence: Synthetic oligonucleotide
cauggccauagacucggug

SEQ ID NO: 4152 - RNA, 19 nt, Artificial Sequence
  Description of Artificial Sequence: Synthetic oligonucleotide
auggccauagacucggugc

SEQ ID NO: 4153 - RNA, 19 nt, Artificial Sequence
  Description of Artificial Sequence: Synthetic oligonucleotide
uggccauagacucggugca

SEQ ID NO: 4154 - RNA, 19 nt, Artificial Sequence
  Description of Artificial Sequence: Synthetic oligonucleotide
ggccauagacucggugcac

SEQ ID NO: 4155 - RNA, 19 nt, Artificial Sequence
  Description of Artificial Sequence: Synthetic oligonucleotide
gccauagacucggugcacc

SEQ ID NO: 4156 - RNA, 19 nt, Artificial Sequence
  Description of Artificial Sequence: Synthetic oligonucleotide
ccauagacucggugcaccg

SEQ ID NO: 4157 - RNA, 19 nt, Artificial Sequence
  Description of Artificial Sequence: Synthetic oligonucleotide
cauagacucggugcaccgg

SEQ ID NO: 4158 - RNA, 19 nt, Artificial Sequence
  Description of Artificial Sequence: Synthetic oligonucleotide
auagacucggugcaccggc

SEQ ID NO: 4159 - RNA, 19 nt, Artificial Sequence
  Description of Artificial Sequence: Synthetic oligonucleotide
uagacucggugcaccggcu

SEQ ID NO: 4160 - RNA, 19 nt, Artificial Sequence
  Description of Artificial Sequence: Synthetic oligonucleotide
agacucggugcaccggcuu

SEQ ID NO: 4161 - RNA, 19 nt, Artificial Sequence
  Description of Artificial Sequence: Synthetic oligonucleotide
gacucggugcaccggcuug

SEQ ID NO: 4162 - RNA, 19 nt, Artificial Sequence
  Description of Artificial Sequence: Synthetic oligonucleotide
acucggugcaccggcuugg

SEQ ID NO: 4163 - RNA, 19 nt, Artificial Sequence
  Description of Artificial Sequence: Synthetic oligonucleotide
cucggugcaccggcuuggc

SEQ ID NO: 4164 - RNA, 19 nt, Artificial Sequence
  Description of Artificial Sequence: Synthetic oligonucleotide
ucggugcaccggcuuggcu

SEQ ID NO: 4165 - RNA, 19 nt, Artificial Sequence
  Description of Artificial Sequence: Synthetic oligonucleotide
cggugcaccggcuuggcua

SEQ ID NO: 4166 - RNA, 19 nt, Artificial Sequence
  Description of Artificial Sequence: Synthetic oligonucleotide
ggugcaccggcuuggcuac

SEQ ID NO: 4167 - RNA, 19 nt, Artificial Sequence
  Description of Artificial Sequence: Synthetic oligonucleotide
gugcaccggcuuggcuacg

SEQ ID NO: 4168 - RNA, 19 nt, Artificial Sequence
  Description of Artificial Sequence: Synthetic oligonucleotide
ugcaccggcuuggcuacgu

SEQ ID NO: 4169 - RNA, 19 nt, Artificial Sequence
  Description of Artificial Sequence: Synthetic oligonucleotide
gcaccggcuuggcuacgug

SEQ ID NO: 4170 - RNA, 19 nt, Artificial Sequence
  Description of Artificial Sequence: Synthetic oligonucleotide
caccggcuuggcuacgugc

SEQ ID NO: 4171 - RNA, 19 nt, Artificial Sequence
  Description of Artificial Sequence: Synthetic oligonucleotide
accggcuuggcuacgugca

SEQ ID NO: 4172 - RNA, 19 nt, Artificial Sequence
  Description of Artificial Sequence: Synthetic oligonucleotide
ccggcuuggcuacgugcac

SEQ ID NO: 4173 - RNA, 19 nt, Artificial Sequence
  Description of Artificial Sequence: Synthetic oligonucleotide
cggcuuggcuacgugcaca

SEQ ID NO: 4174 - RNA, 19 nt, Artificial Sequence
  Description of Artificial Sequence: Synthetic oligonucleotide
ggcuuggcuacgugcacag

SEQ ID NO: 4175 - RNA, 19 nt, Artificial Sequence
  Description of Artificial Sequence: Synthetic oligonucleotide
gcuuggcuacgugcacagg

SEQ ID NO: 4176 - RNA, 19 nt, Artificial Sequence
  Description of Artificial Sequence: Synthetic oligonucleotide
cuuggcuacgugcacaggg

SEQ ID NO: 4177 - RNA, 19 nt, Artificial Sequence
  Description of Artificial Sequence: Synthetic oligonucleotide
uuggcuacgugcacaggga

SEQ ID NO: 4178 - RNA, 19 nt, Artificial Sequence
  Description of Artificial Sequence: Synthetic oligonucleotide
uggcuacgugcacagggac

SEQ ID NO: 4179 - RNA, 19 nt, Artificial Sequence
  Description of Artificial Sequence: Synthetic oligonucleotide
ggcuacgugcacagggaca

SEQ ID NO: 4180 - RNA, 19 nt, Artificial Sequence
  Description of Artificial Sequence: Synthetic oligonucleotide
gcuacgugcacagggacau

SEQ ID NO: 4181 - RNA, 19 nt, Artificial Sequence
  Description of Artificial Sequence: Synthetic oligonucleotide
cuacgugcacagggacauc

SEQ ID NO: 4182 - RNA, 19 nt, Artificial Sequence
  Description of Artificial Sequence: Synthetic oligonucleotide
uacgugcacagggacauca

SEQ ID NO: 4183 - RNA, 19 nt, Artificial Sequence
  Description of Artificial Sequence: Synthetic oligonucleotide
acgugcacagggacaucaa

SEQ ID NO: 4184 - RNA, 19 nt, Artificial Sequence
  Description of Artificial Sequence: Synthetic oligonucleotide
cgugcacagggacaucaaa

SEQ ID NO: 4185 - RNA, 19 nt, Artificial Sequence
  Description of Artificial Sequence: Synthetic oligonucleotide
gugcacagggacaucaaac

SEQ ID NO: 4186 - RNA, 19 nt, Artificial Sequence
  Description of Artificial Sequence: Synthetic oligonucleotide
ugcacagggacaucaaacc

SEQ ID NO: 4187 - RNA, 19 nt, Artificial Sequence
  Description of Artificial Sequence: Synthetic oligonucleotide
gcacagggacaucaaaccc

SEQ ID NO: 4188 - RNA, 19 nt, Artificial Sequence
  Description of Artificial Sequence: Synthetic oligonucleotide
cacagggacaucaaacccg

SEQ ID NO: 4189 - RNA, 19 nt, Artificial Sequence
  Description of Artificial Sequence: Synthetic oligonucleotide
acagggacaucaaacccga

SEQ ID NO: 4190 - RNA, 19 nt, Artificial Sequence
  Description of Artificial Sequence: Synthetic oligonucleotide
cagggacaucaaacccgac

SEQ ID NO: 4191 - RNA, 19 nt, Artificial Sequence
  Description of Artificial Sequence: Synthetic oligonucleotide
agggacaucaaacccgaca

SEQ ID NO: 4192 - RNA, 19 nt, Artificial Sequence
  Description of Artificial Sequence: Synthetic oligonucleotide
gggacaucaaacccgacaa

SEQ ID NO: 4193 - RNA, 19 nt, Artificial Sequence
  Description of Artificial Sequence: Synthetic oligonucleotide
ggacaucaaacccgacaac

SEQ ID NO: 4194 - RNA, 19 nt, Artificial Sequence
  Description of Artificial Sequence: Synthetic oligonucleotide
gacaucaaacccgacaaca

SEQ ID NO: 4195 - RNA, 19 nt, Artificial Sequence
  Description of Artificial Sequence: Synthetic oligonucleotide
acaucaaacccgacaacau

SEQ ID NO: 4196 - RNA, 19 nt, Artificial Sequence
  Description of Artificial Sequence: Synthetic oligonucleotide
caucaaacccgacaacauc

SEQ ID NO: 4197 - RNA, 19 nt, Artificial Sequence
  Description of Artificial Sequence: Synthetic oligonucleotide
aucaaacccgacaacaucc

SEQ ID NO: 4198 - RNA, 19 nt, Artificial Sequence
  Description of Artificial Sequence: Synthetic oligonucleotide
ucaaacccgacaacauccu

SEQ ID NO: 4199 - RNA, 19 nt, Artificial Sequence
  Description of Artificial Sequence: Synthetic oligonucleotide
caaacccgacaacauccug

SEQ ID NO: 4200 - RNA, 19 nt, Artificial Sequence
  Description of Artificial Sequence: Synthetic oligonucleotide
aaacccgacaacauccugc

SEQ ID NO: 4201 - RNA, 19 nt, Artificial Sequence
  Description of Artificial Sequence: Synthetic oligonucleotide
aacccgacaacauccugcu

SEQ ID NO: 4202 - RNA, 19 nt, Artificial Sequence
  Description of Artificial Sequence: Synthetic oligonucleotide
acccgacaacauccugcug

SEQ ID NO: 4203 - RNA, 19 nt, Artificial Sequence
  Description of Artificial Sequence: Synthetic oligonucleotide
cccgacaacauccugcugg

SEQ ID NO: 4204 - RNA, 19 nt, Artificial Sequence
  Description of Artificial Sequence: Synthetic oligonucleotide
ccgacaacauccugcugga

SEQ ID NO: 4205 - RNA, 19 nt, Artificial Sequence
  Description of Artificial Sequence: Synthetic oligonucleotide
cgacaacauccugcuggac

SEQ ID NO: 4206 - RNA, 19 nt, Artificial Sequence
  Description of Artificial Sequence: Synthetic oligonucleotide
gacaacauccugcuggacc

SEQ ID NO: 4207 - RNA, 19 nt, Artificial Sequence
  Description of Artificial Sequence: Synthetic oligonucleotide
acaacauccugcuggaccg

SEQ ID NO: 4208 - RNA, 19 nt, Artificial Sequence
  Description of Artificial Sequence: Synthetic oligonucleotide
caacauccugcuggaccgc

SEQ ID NO: 4209 - RNA, 19 nt, Artificial Sequence
  Description of Artificial Sequence: Synthetic oligonucleotide
aacauccugcuggaccgcu

SEQ ID NO: 4210 - RNA, 19 nt, Artificial Sequence
  Description of Artificial Sequence: Synthetic oligonucleotide
acauccugcuggaccgcug

SEQ ID NO: 4211 - RNA, 19 nt, Artificial Sequence
  Description of Artificial Sequence: Synthetic oligonucleotide
cauccugcuggaccgcugu

SEQ ID NO: 4212 - RNA, 19 nt, Artificial Sequence
  Description of Artificial Sequence: Synthetic oligonucleotide
auccugcuggaccgcugug

SEQ ID NO: 4213 - RNA, 19 nt, Artificial Sequence
  Description of Artificial Sequence: Synthetic oligonucleotide
uccugcuggaccgcugugg

SEQ ID NO: 4214 - RNA, 19 nt, Artificial Sequence
  Description of Artificial Sequence: Synthetic oligonucleotide
ccugcuggaccgcuguggc

SEQ ID NO: 4215 - RNA, 19 nt, Artificial Sequence
  Description of Artificial Sequence: Synthetic oligonucleotide
cugcuggaccgcuguggcc

SEQ ID NO: 4216 - RNA, 19 nt, Artificial Sequence
  Description of Artificial Sequence: Synthetic oligonucleotide
ugcuggaccgcuguggcca

SEQ ID NO: 4217 - RNA, 19 nt, Artificial Sequence
  Description of Artificial Sequence: Synthetic oligonucleotide
gcuggaccgcuguggccac

SEQ ID NO: 4218 - RNA, 19 nt, Artificial Sequence
  Description of Artificial Sequence: Synthetic oligonucleotide
cuggaccgcuguggccaca

SEQ ID NO: 4219 - RNA, 19 nt, Artificial Sequence
  Description of Artificial Sequence: Synthetic oligonucleotide
uggaccgcuguggccacau

SEQ ID NO: 4220 - RNA, 19 nt, Artificial Sequence
  Description of Artificial Sequence: Synthetic oligonucleotide
ggaccgcuguggccacauc

SEQ ID NO: 4221 - RNA, 19 nt, Artificial Sequence
  Description of Artificial Sequence: Synthetic oligonucleotide
gaccgcuguggccacaucc

SEQ ID NO: 4222 - RNA, 19 nt, Artificial Sequence
  Description of Artificial Sequence: Synthetic oligonucleotide
accgcuguggccacauccg

SEQ ID NO: 4223 - RNA, 19 nt, Artificial Sequence
  Description of Artificial Sequence: Synthetic oligonucleotide
ccgcuguggccacauccgc

SEQ ID NO: 4224 - RNA, 19 nt, Artificial Sequence
  Description of Artificial Sequence: Synthetic oligonucleotide
cgcuguggccacauccgcc

SEQ ID NO: 4225 - RNA, 19 nt, Artificial Sequence
  Description of Artificial Sequence: Synthetic oligonucleotide
gcuguggccacauccgccu

SEQ ID NO: 4226 - RNA, 19 nt, Artificial Sequence
  Description of Artificial Sequence: Synthetic oligonucleotide
cuguggccacauccgccug

SEQ ID NO: 4227 - RNA, 19 nt, Artificial Sequence
  Description of Artificial Sequence: Synthetic oligonucleotide
uguggccacauccgccugg

SEQ ID NO: 4228 - RNA, 19 nt, Artificial Sequence
  Description of Artificial Sequence: Synthetic oligonucleotide
guggccacauccgccuggc

SEQ ID NO: 4229 - RNA, 19 nt, Artificial Sequence
  Description of Artificial Sequence: Synthetic oligonucleotide
uggccacauccgccuggcc

SEQ ID NO: 4230 - RNA, 19 nt, Artificial Sequence
  Description of Artificial Sequence: Synthetic oligonucleotide
ggccacauccgccuggccg

SEQ ID NO: 4231 - RNA, 19 nt, Artificial Sequence
  Description of Artificial Sequence: Synthetic oligonucleotide
gccacauccgccuggccga

SEQ ID NO: 4232 - RNA, 19 nt, Artificial Sequence
  Description of Artificial Sequence: Synthetic oligonucleotide
ccacauccgccuggccgac

SEQ ID NO: 4233 - RNA, 19 nt, Artificial Sequence
  Description of Artificial Sequence: Synthetic oligonucleotide
cacauccgccuggccgacu

SEQ ID NO: 4234 - RNA, 19 nt, Artificial Sequence
  Description of Artificial Sequence: Synthetic oligonucleotide
acauccgccuggccgacuu

SEQ ID NO: 4235 - RNA, 19 nt, Artificial Sequence
  Description of Artificial Sequence: Synthetic oligonucleotide
cauccgccuggccgacuuc

SEQ ID NO: 4236 - RNA, 19 nt, Artificial Sequence
  Description of Artificial Sequence: Synthetic oligonucleotide
auccgccuggccgacuucg

SEQ ID NO: 4237 - RNA, 19 nt, Artificial Sequence
  Description of Artificial Sequence: Synthetic oligonucleotide
uccgccuggccgacuucgg

SEQ ID NO: 4238 - RNA, 19 nt, Artificial Sequence
  Description of Artificial Sequence: Synthetic oligonucleotide
ccgccuggccgacuucggc

SEQ ID NO: 4239 - RNA, 19 nt, Artificial Sequence
  Description of Artificial Sequence: Synthetic oligonucleotide
cgccuggccgacuucggcu

SEQ ID NO: 4240 - RNA, 19 nt, Artificial Sequence
  Description of Artificial Sequence: Synthetic oligonucleotide
gccuggccgacuucggcuc

SEQ ID NO: 4241 - RNA, 19 nt, Artificial Sequence
  Description of Artificial Sequence: Synthetic oligonucleotide
ccuggccgacuucggcucu

SEQ ID NO: 4242 - RNA, 19 nt, Artificial Sequence
  Description of Artificial Sequence: Synthetic oligonucleotide
cuggccgacuucggcucuu

SEQ ID NO: 4243 - RNA, 19 nt, Artificial Sequence
  Description of Artificial Sequence: Synthetic oligonucleotide
uggccgacuucggcucuug

SEQ ID NO: 4244 - RNA, 19 nt, Artificial Sequence
  Description of Artificial Sequence: Synthetic oligonucleotide
ggccgacuucggcucuugc

SEQ ID NO: 4245 - RNA, 19 nt, Artificial Sequence
  Description of Artificial Sequence: Synthetic oligonucleotide
gccgacuucggcucuugcc

SEQ ID NO: 4246 - RNA, 19 nt, Artificial Sequence
  Description of Artificial Sequence: Synthetic oligonucleotide
ccgacuucggcucuugccu

SEQ ID NO: 4247 - RNA, 19 nt, Artificial Sequence
  Description of Artificial Sequence: Synthetic oligonucleotide
cgacuucggcucuugccuc

SEQ ID NO: 4248 - RNA, 19 nt, Artificial Sequence
  Description of Artificial Sequence: Synthetic oligonucleotide
gacuucggcucuugccuca

SEQ ID NO: 4249 - RNA, 19 nt, Artificial Sequence
  Description of Artificial Sequence: Synthetic oligonucleotide
acuucggcucuugccucaa

SEQ ID NO: 4250 - RNA, 19 nt, Artificial Sequence
  Description of Artificial Sequence: Synthetic oligonucleotide
cuucggcucuugccucaag

SEQ ID NO: 4251 - RNA, 19 nt, Artificial Sequence
  Description of Artificial Sequence: Synthetic oligonucleotide
uucggcucuugccucaagc

SEQ ID NO: 4252 - RNA, 19 nt, Artificial Sequence
  Description of Artificial Sequence: Synthetic oligonucleotide
ucggcucuugccucaagcu

SEQ ID NO: 4253 - RNA, 19 nt, Artificial Sequence
  Description of Artificial Sequence: Synthetic oligonucleotide
cggcucuugccucaagcug

SEQ ID NO: 4254 - RNA, 19 nt, Artificial Sequence
  Description of Artificial Sequence: Synthetic oligonucleotide
ggcucuugccucaagcugc

SEQ ID NO: 4255 - RNA, 19 nt, Artificial Sequence
  Description of Artificial Sequence: Synthetic oligonucleotide
gcucuugccucaagcugcg

SEQ ID NO: 4256 - RNA, 19 nt, Artificial Sequence
  Description of Artificial Sequence: Synthetic oligonucleotide
cucuugccucaagcugcgg

SEQ ID NO: 4257 - RNA, 19 nt, Artificial Sequence
  Description of Artificial Sequence: Synthetic oligonucleotide
ucuugccucaagcugcggg

SEQ ID NO: 4258 - RNA, 19 nt, Artificial Sequence
  Description of Artificial Sequence: Synthetic oligonucleotide
cuugccucaagcugcgggc

SEQ ID NO: 4259 - RNA, 19 nt, Artificial Sequence
  Description of Artificial Sequence: Synthetic oligonucleotide
uugccucaagcugcgggca

SEQ ID NO: 4260 - RNA, 19 nt, Artificial Sequence
  Description of Artificial Sequence: Synthetic oligonucleotide
ugccucaagcugcgggcag

SEQ ID NO: 4261 - RNA, 19 nt, Artificial Sequence
  Description of Artificial Sequence: Synthetic oligonucleotide
gccucaagcugcgggcaga

SEQ ID NO: 4262 - RNA, 19 nt, Artificial Sequence
  Description of Artificial Sequence: Synthetic oligonucleotide
ccucaagcugcgggcagau

SEQ ID NO: 4263 - RNA, 19 nt, Artificial Sequence
  Description of Artificial Sequence: Synthetic oligonucleotide
cucaagcugcgggcagaug

SEQ ID NO: 4264 - RNA, 19 nt, Artificial Sequence
  Description of Artificial Sequence: Synthetic oligonucleotide
ucaagcugcgggcagaugg

SEQ ID NO: 4265 - RNA, 19 nt, Artificial Sequence
  Description of Artificial Sequence: Synthetic oligonucleotide
caagcugcgggcagaugga

SEQ ID NO: 4266 - RNA, 19 nt, Artificial Sequence
  Description of Artificial Sequence: Synthetic oligonucleotide
aagcugcgggcagauggaa

SEQ ID NO: 4267 - RNA, 19 nt, Artificial Sequence
  Description of Artificial Sequence: Synthetic oligonucleotide
agcugcgggcagauggaac

SEQ ID NO: 4268 - RNA, 19 nt, Artificial Sequence
  Description of Artificial Sequence: Synthetic oligonucleotide
gcugcgggcagauggaacg

SEQ ID NO: 4269 - RNA, 19 nt, Artificial Sequence
  Description of Artificial Sequence: Synthetic oligonucleotide
cugcgggcagauggaacgg

SEQ ID NO: 4270 - RNA, 19 nt, Artificial Sequence
  Description of Artificial Sequence: Synthetic oligonucleotide
ugcgggcagauggaacggu

SEQ ID NO: 4271 - RNA, 19 nt, Artificial Sequence
  Description of Artificial Sequence: Synthetic oligonucleotide
gcgggcagauggaacggug

SEQ ID NO: 4272 - RNA, 19 nt, Artificial Sequence
  Description of Artificial Sequence: Synthetic oligonucleotide
cgggcagauggaacggugc

SEQ ID NO: 4273 - RNA, 19 nt, Artificial Sequence
  Description of Artificial Sequence: Synthetic oligonucleotide
gggcagauggaacggugcg

SEQ ID NO: 4274 - RNA, 19 nt, Artificial Sequence
  Description of Artificial Sequence: Synthetic oligonucleotide
ggcagauggaacggugcgg

SEQ ID NO: 4275 - RNA, 19 nt, Artificial Sequence
  Description of Artificial Sequence: Synthetic oligonucleotide
gcagauggaacggugcggu

SEQ ID NO: 4276 - RNA, 19 nt, Artificial Sequence
  Description of Artificial Sequence: Synthetic oligonucleotide
cagauggaacggugcgguc

SEQ ID NO: 4277 - RNA, 19 nt, Artificial Sequence
  Description of Artificial Sequence: Synthetic oligonucleotide
agauggaacggugcggucg

SEQ ID NO: 4278 - RNA, 19 nt, Artificial Sequence
  Description of Artificial Sequence: Synthetic oligonucleotide
gauggaacggugcggucgc

SEQ ID NO: 4279 - RNA, 19 nt, Artificial Sequence
  Description of Artificial Sequence: Synthetic oligonucleotide
auggaacggugcggucgcu

SEQ ID NO: 4280 - RNA, 19 nt, Artificial Sequence
  Description of Artificial Sequence: Synthetic oligonucleotide
uggaacggugcggucgcug

SEQ ID NO: 4281 - RNA, 19 nt, Artificial Sequence
  Description of Artificial Sequence: Synthetic oligonucleotide
ggaacggugcggucgcugg

SEQ ID NO: 4282 - RNA, 19 nt, Artificial Sequence
  Description of Artificial Sequence: Synthetic oligonucleotide
gaacggugcggucgcuggu

SEQ ID NO: 4283 - RNA, 19 nt, Artificial Sequence
  Description of Artificial Sequence: Synthetic oligonucleotide
aacggugcggucgcuggug

SEQ ID NO: 4284 - RNA, 19 nt, Artificial Sequence
  Description of Artificial Sequence: Synthetic oligonucleotide
acggugcggucgcuggugg

SEQ ID NO: 4285 - RNA, 19 nt, Artificial Sequence
  Description of Artificial Sequence: Synthetic oligonucleotide
cggugcggucgcugguggc

SEQ ID NO: 4286 - RNA, 19 nt, Artificial Sequence
  Description of Artificial Sequence: Synthetic oligonucleotide
ggugcggucgcugguggcu

SEQ ID NO: 4287 - RNA, 19 nt, Artificial Sequence
  Description of Artificial Sequence: Synthetic oligonucleotide
gugcggucgcugguggcug

SEQ ID NO: 4288 - RNA, 19 nt, Artificial Sequence
  Description of Artificial Sequence: Synthetic oligonucleotide
ugcggucgcugguggcugu

SEQ ID NO: 4289 - RNA, 19 nt, Artificial Sequence
  Description of Artificial Sequence: Synthetic oligonucleotide
gcggucgcugguggcugug

SEQ ID NO: 4290 - RNA, 19 nt, Artificial Sequence
  Description of Artificial Sequence: Synthetic oligonucleotide
cggucgcugguggcugugg

SEQ ID NO: 4291 - RNA, 19 nt, Artificial Sequence
  Description of Artificial Sequence: Synthetic oligonucleotide
ggucgcugguggcuguggg

SEQ ID NO: 4292 - RNA, 19 nt, Artificial Sequence
  Description of Artificial Sequence: Synthetic oligonucleotide
gucgcugguggcugugggc

SEQ ID NO: 4293 - RNA, 19 nt, Artificial Sequence
  Description of Artificial Sequence: Synthetic oligonucleotide
ucgcugguggcugugggca

SEQ ID NO: 4294 - RNA, 19 nt, Artificial Sequence
  Description of Artificial Sequence: Synthetic oligonucleotide
cgcugguggcugugggcac

SEQ ID NO: 4295 - RNA, 19 nt, Artificial Sequence
  Description of Artificial Sequence: Synthetic oligonucleotide
gcugguggcugugggcacc

SEQ ID NO: 4296 - RNA, 19 nt, Artificial Sequence
  Description of Artificial Sequence: Synthetic oligonucleotide
cugguggcugugggcaccc

SEQ ID NO: 4297 - RNA, 19 nt, Artificial Sequence
  Description of Artificial Sequence: Synthetic oligonucleotide
ugguggcugugggcacccc

SEQ ID NO: 4298 - RNA, 19 nt, Artificial Sequence
  Description of Artificial Sequence: Synthetic oligonucleotide
gguggcugugggcacccca

SEQ ID NO: 4299 - RNA, 19 nt, Artificial Sequence
  Description of Artificial Sequence: Synthetic oligonucleotide
guggcugugggcaccccag

SEQ ID NO: 4300 - RNA, 19 nt, Artificial Sequence
  Description of Artificial Sequence: Synthetic oligonucleotide
uggcugugggcaccccaga

SEQ ID NO: 4301 - RNA, 19 nt, Artificial Sequence
  Description of Artificial Sequence: Synthetic oligonucleotide
ggcugugggcaccccagac

SEQ ID NO: 4302 - RNA, 19 nt, Artificial Sequence
  Description of Artificial Sequence: Synthetic oligonucleotide
gcugugggcaccccagacu

SEQ ID NO: 4303 - RNA, 19 nt, Artificial Sequence
  Description of Artificial Sequence: Synthetic oligonucleotide
cugugggcaccccagacua

SEQ ID NO: 4304 - RNA, 19 nt, Artificial Sequence
  Description of Artificial Sequence: Synthetic oligonucleotide
ugugggcaccccagacuac

SEQ ID NO: 4305 - RNA, 19 nt, Artificial Sequence
  Description of Artificial Sequence: Synthetic oligonucleotide
gugggcaccccagacuacc

SEQ ID NO: 4306 - RNA, 19 nt, Artificial Sequence
  Description of Artificial Sequence: Synthetic oligonucleotide
ugggcaccccagacuaccu

SEQ ID NO: 4307 - RNA, 19 nt, Artificial Sequence
  Description of Artificial Sequence: Synthetic oligonucleotide
gggcaccccagacuaccug

SEQ ID NO: 4308 - RNA, 19 nt, Artificial Sequence
  Description of Artificial Sequence: Synthetic oligonucleotide
ggcaccccagacuaccugu

SEQ ID NO: 4309 - RNA, 19 nt, Artificial Sequence
  Description of Artificial Sequence: Synthetic oligonucleotide
gcaccccagacuaccuguc

SEQ ID NO: 4310 - RNA, 19 nt, Artificial Sequence
  Description of Artificial Sequence: Synthetic oligonucleotide
caccccagacuaccugucc

SEQ ID NO: 4311 - RNA, 19 nt, Artificial Sequence
  Description of Artificial Sequence: Synthetic oligonucleotide
accccagacuaccuguccc

SEQ ID NO: 4312 - RNA, 19 nt, Artificial Sequence
  Description of Artificial Sequence: Synthetic oligonucleotide
ccccagacuaccugucccc

SEQ ID NO: 4313 - RNA, 19 nt, Artificial Sequence
  Description of Artificial Sequence: Synthetic oligonucleotide
cccagacuaccuguccccc

SEQ ID NO: 4314 - RNA, 19 nt, Artificial Sequence
  Description of Artificial Sequence: Synthetic oligonucleotide
ccagacuaccugucccccg

SEQ ID NO: 4315 - RNA, 19 nt, Artificial Sequence
  Description of Artificial Sequence: Synthetic oligonucleotide
cagacuaccugucccccga

SEQ ID NO: 4316 - RNA, 19 nt, Artificial Sequence
  Description of Artificial Sequence: Synthetic oligonucleotide
agacuaccugucccccgag

SEQ ID NO: 4317 - RNA, 19 nt, Artificial Sequence
  Description of Artificial Sequence: Synthetic oligonucleotide
gacuaccugucccccgaga

SEQ ID NO: 4318 - RNA, 19 nt, Artificial Sequence
  Description of Artificial Sequence: Synthetic oligonucleotide
acuaccugucccccgagau

SEQ ID NO: 4319 - RNA, 19 nt, Artificial Sequence
  Description of Artificial Sequence: Synthetic oligonucleotide
cuaccugucccccgagauc

SEQ ID NO: 4320 - RNA, 19 nt, Artificial Sequence
  Description of Artificial Sequence: Synthetic oligonucleotide
uaccugucccccgagaucc

SEQ ID NO: 4321 - RNA, 19 nt, Artificial Sequence
  Description of Artificial Sequence: Synthetic oligonucleotide
accugucccccgagauccu

SEQ ID NO: 4322 - RNA, 19 nt, Artificial Sequence
  Description of Artificial Sequence: Synthetic oligonucleotide
ccugucccccgagauccug

SEQ ID NO: 4323 - RNA, 19 nt, Artificial Sequence
  Description of Artificial Sequence: Synthetic oligonucleotide
cugucccccgagauccugc

SEQ ID NO: 4324 - RNA, 19 nt, Artificial Sequence
  Description of Artificial Sequence: Synthetic oligonucleotide
ugucccccgagauccugca

SEQ ID NO: 4325 - RNA, 19 nt, Artificial Sequence
  Description of Artificial Sequence: Synthetic oligonucleotide
gucccccgagauccugcag

SEQ ID NO: 4326 - RNA, 19 nt, Artificial Sequence
  Description of Artificial Sequence: Synthetic oligonucleotide
ucccccgagauccugcagg

SEQ ID NO: 4327 - RNA, 19 nt, Artificial Sequence
  Description of Artificial Sequence: Synthetic oligonucleotide
cccccgagauccugcaggc

SEQ ID NO: 4328 - RNA, 19 nt, Artificial Sequence
  Description of Artificial Sequence: Synthetic oligonucleotide
ccccgagauccugcaggcu

SEQ ID NO: 4329 - RNA, 19 nt, Artificial Sequence
  Description of Artificial Sequence: Synthetic oligonucleotide
cccgagauccugcaggcug

SEQ ID NO: 4330 - RNA, 19 nt, Artificial Sequence
  Description of Artificial Sequence: Synthetic oligonucleotide
ccgagauccugcaggcugu

SEQ ID NO: 4331 - RNA, 19 nt, Artificial Sequence
  Description of Artificial Sequence: Synthetic oligonucleotide
cgagauccugcaggcugug

SEQ ID NO: 4332 - RNA, 19 nt, Artificial Sequence
  Description of Artificial Sequence: Synthetic oligonucleotide
gagauccugcaggcugugg

SEQ ID NO: 4333 - RNA, 19 nt, Artificial Sequence
  Description of Artificial Sequence: Synthetic oligonucleotide
agauccugcaggcuguggg

SEQ ID NO: 4334 - RNA, 19 nt, Artificial Sequence
  Description of Artificial Sequence: Synthetic oligonucleotide
gauccugcaggcugugggc

SEQ ID NO: 4335 - RNA, 19 nt, Artificial Sequence
  Description of Artificial Sequence: Synthetic oligonucleotide
auccugcaggcugugggcg

SEQ ID NO: 4336 - RNA, 19 nt, Artificial Sequence
  Description of Artificial Sequence: Synthetic oligonucleotide
uccugcaggcugugggcgg

SEQ ID NO: 4337 - RNA, 19 nt, Artificial Sequence
  Description of Artificial Sequence: Synthetic oligonucleotide
ccugcaggcugugggcggu

SEQ ID NO: 4338 - RNA, 19 nt, Artificial Sequence
  Description of Artificial Sequence: Synthetic oligonucleotide
cugcaggcugugggcggug

SEQ ID NO: 4339 - RNA, 19 nt, Artificial Sequence
  Description of Artificial Sequence: Synthetic oligonucleotide
ugcaggcugugggcggugg

SEQ ID NO: 4340 - RNA, 19 nt, Artificial Sequence
  Description of Artificial Sequence: Synthetic oligonucleotide
gcaggcugugggcgguggg

SEQ ID NO: 4341 - RNA, 19 nt, Artificial Sequence
  Description of Artificial Sequence: Synthetic oligonucleotide
caggcugugggcggugggc

SEQ ID NO: 4342 - RNA, 19 nt, Artificial Sequence
  Description of Artificial Sequence: Synthetic oligonucleotide
aggcugugggcggugggcc

SEQ ID NO: 4343 - RNA, 19 nt, Artificial Sequence
  Description of Artificial Sequence: Synthetic oligonucleotide
ggcugugggcggugggccu

SEQ ID NO: 4344 - RNA, 19 nt, Artificial Sequence
  Description of Artificial Sequence: Synthetic oligonucleotide
gcugugggcggugggccug

SEQ ID NO: 4345 - RNA, 19 nt, Artificial Sequence
  Description of Artificial Sequence: Synthetic oligonucleotide
cugugggcggugggccugg

SEQ ID NO: 4346 - RNA, 19 nt, Artificial Sequence
  Description of Artificial Sequence: Synthetic oligonucleotide
ugugggcggugggccuggg

SEQ ID NO: 4347 - RNA, 19 nt, Artificial Sequence
  Description of Artificial Sequence: Synthetic oligonucleotide
gugggcggugggccuggga

SEQ ID NO: 4348 - RNA, 19 nt, Artificial Sequence
  Description of Artificial Sequence: Synthetic oligonucleotide
ugggcggugggccugggac

SEQ ID NO: 4349 - RNA, 19 nt, Artificial Sequence
  Description of Artificial Sequence: Synthetic oligonucleotide
gggcggugggccugggaca

SEQ ID NO: 4350 - RNA, 19 nt, Artificial Sequence
  Description of Artificial Sequence: Synthetic oligonucleotide
ggcggugggccugggacag

SEQ ID NO: 4351 - RNA, 19 nt, Artificial Sequence
  Description of Artificial Sequence: Synthetic oligonucleotide
gcggugggccugggacagg

SEQ ID NO: 4352 - RNA, 19 nt, Artificial Sequence
  Description of Artificial Sequence: Synthetic oligonucleotide
cggugggccugggacaggc

SEQ ID NO: 4353 - RNA, 19 nt, Artificial Sequence
  Description of Artificial Sequence: Synthetic oligonucleotide
ggugggccugggacaggca

SEQ ID NO: 4354 - RNA, 19 nt, Artificial Sequence
  Description of Artificial Sequence: Synthetic oligonucleotide
gugggccugggacaggcag

SEQ ID NO: 4355 - RNA, 19 nt, Artificial Sequence
  Description of Artificial Sequence: Synthetic oligonucleotide
ugggccugggacaggcagc

SEQ ID NO: 4356 - RNA, 19 nt, Artificial Sequence
  Description of Artificial Sequence: Synthetic oligonucleotide
gggccugggacaggcagcu

SEQ ID NO: 4357 - RNA, 19 nt, Artificial Sequence
  Description of Artificial Sequence: Synthetic oligonucleotide
ggccugggacaggcagcua

SEQ ID NO: 4358 - RNA, 19 nt, Artificial Sequence
  Description of Artificial Sequence: Synthetic oligonucleotide
gccugggacaggcagcuac

SEQ ID NO: 4359 - RNA, 19 nt, Artificial Sequence
  Description of Artificial Sequence: Synthetic oligonucleotide
ccugggacaggcagcuacg

SEQ ID NO: 4360 - RNA, 19 nt, Artificial Sequence
  Description of Artificial Sequence: Synthetic oligonucleotide
cugggacaggcagcuacgg

SEQ ID NO: 4361 - RNA, 19 nt, Artificial Sequence
  Description of Artificial Sequence: Synthetic oligonucleotide
ugggacaggcagcuacggg

SEQ ID NO: 4362 - RNA, 19 nt, Artificial Sequence
  Description of Artificial Sequence: Synthetic oligonucleotide
gggacaggcagcuacgggc

SEQ ID NO: 4363 - RNA, 19 nt, Artificial Sequence
  Description of Artificial Sequence: Synthetic oligonucleotide
ggacaggcagcuacgggcc

SEQ ID NO: 4364 - RNA, 19 nt, Artificial Sequence
  Description of Artificial Sequence: Synthetic oligonucleotide
gacaggcagcuacgggccc

SEQ ID NO: 4365 - RNA, 19 nt, Artificial Sequence
  Description of Artificial Sequence: Synthetic oligonucleotide
acaggcagcuacgggcccg

SEQ ID NO: 4366 - RNA, 19 nt, Artificial Sequence
  Description of Artificial Sequence: Synthetic oligonucleotide
caggcagcuacgggcccga

SEQ ID NO: 4367 - RNA, 19 nt, Artificial Sequence
  Description of Artificial Sequence: Synthetic oligonucleotide
aggcagcuacgggcccgag

SEQ ID NO: 4368 - RNA, 19 nt, Artificial Sequence
  Description of Artificial Sequence: Synthetic oligonucleotide
ggcagcuacgggcccgagu

SEQ ID NO: 4369 - RNA, 19 nt, Artificial Sequence
  Description of Artificial Sequence: Synthetic oligonucleotide
gcagcuacgggcccgagug

SEQ ID NO: 4370 - RNA, 19 nt, Artificial Sequence
  Description of Artificial Sequence: Synthetic oligonucleotide
cagcuacgggcccgagugu

SEQ ID NO: 4371 - RNA, 19 nt, Artificial Sequence
  Description of Artificial Sequence: Synthetic oligonucleotide
agcuacgggcccgagugug

SEQ ID NO: 4372 - RNA, 19 nt, Artificial Sequence
  Description of Artificial Sequence: Synthetic oligonucleotide
gcuacgggcccgaguguga

SEQ ID NO: 4373 - RNA, 19 nt, Artificial Sequence
  Description of Artificial Sequence: Synthetic oligonucleotide
cuacgggcccgagugugac

SEQ ID NO: 4374 - RNA, 19 nt, Artificial Sequence
  Description of Artificial Sequence: Synthetic oligonucleotide
uacgggcccgagugugacu

SEQ ID NO: 4375 - RNA, 19 nt, Artificial Sequence
  Description of Artificial Sequence: Synthetic oligonucleotide
acgggcccgagugugacug

SEQ ID NO: 4376 - RNA, 19 nt, Artificial Sequence
  Description of Artificial Sequence: Synthetic oligonucleotide
cgggcccgagugugacugg

SEQ ID NO: 4377 - RNA, 19 nt, Artificial Sequence
  Description of Artificial Sequence: Synthetic oligonucleotide
gggcccgagugugacuggu

SEQ ID NO: 4378 - RNA, 19 nt, Artificial Sequence
  Description of Artificial Sequence: Synthetic oligonucleotide
ggcccgagugugacuggug

SEQ ID NO: 4379 - RNA, 19 nt, Artificial Sequence
  Description of Artificial Sequence: Synthetic oligonucleotide
gcccgagugugacuggugg

SEQ ID NO: 4380 - RNA, 19 nt, Artificial Sequence
  Description of Artificial Sequence: Synthetic oligonucleotide
cccgagugugacugguggg

SEQ ID NO: 4381 - RNA, 19 nt, Artificial Sequence
  Description of Artificial Sequence: Synthetic oligonucleotide
ccgagugugacuggugggc

SEQ ID NO: 4382 - RNA, 19 nt, Artificial Sequence
  Description of Artificial Sequence: Synthetic oligonucleotide
cgagugugacuggugggcg

SEQ ID NO: 4383 - RNA, 19 nt, Artificial Sequence
  Description of Artificial Sequence: Synthetic oligonucleotide
gagugugacuggugggcgc

SEQ ID NO: 4384 - RNA, 19 nt, Artificial Sequence
  Description of Artificial Sequence: Synthetic oligonucleotide
agugugacuggugggcgcu

SEQ ID NO: 4385 - RNA, 19 nt, Artificial Sequence
  Description of Artificial Sequence: Synthetic oligonucleotide
gugugacuggugggcgcug

SEQ ID NO: 4386 - RNA, 19 nt, Artificial Sequence
  Description of Artificial Sequence: Synthetic oligonucleotide
ugugacuggugggcgcugg

SEQ ID NO: 4387 - RNA, 19 nt, Artificial Sequence
  Description of Artificial Sequence: Synthetic oligonucleotide
gugacuggugggcgcuggg

SEQ ID NO: 4388 - RNA, 19 nt, Artificial Sequence
  Description of Artificial Sequence: Synthetic oligonucleotide
ugacuggugggcgcugggu

SEQ ID NO: 4389 - RNA, 19 nt, Artificial Sequence
  Description of Artificial Sequence: Synthetic oligonucleotide
gacuggugggcgcugggug

SEQ ID NO: 4390 - RNA, 19 nt, Artificial Sequence
  Description of Artificial Sequence: Synthetic oligonucleotide
acuggugggcgcugggugu

SEQ ID NO: 4391 - RNA, 19 nt, Artificial Sequence
  Description of Artificial Sequence: Synthetic oligonucleotide
cuggugggcgcugggugua

SEQ ID NO: 4392 - RNA, 19 nt, Artificial Sequence
  Description of Artificial Sequence: Synthetic oligonucleotide
uggugggcgcuggguguau

SEQ ID NO: 4393 - RNA, 19 nt, Artificial Sequence
  Description of Artificial Sequence: Synthetic oligonucleotide
ggugggcgcuggguguauu

SEQ ID NO: 4394 - RNA, 19 nt, Artificial Sequence
  Description of Artificial Sequence: Synthetic oligonucleotide
gugggcgcuggguguauuc

SEQ ID NO: 4395 - RNA, 19 nt, Artificial Sequence
  Description of Artificial Sequence: Synthetic oligonucleotide
ugggcgcuggguguauucg

SEQ ID NO: 4396 - RNA, 19 nt, Artificial Sequence
  Description of Artificial Sequence: Synthetic oligonucleotide
gggcgcuggguguauucgc

SEQ ID NO: 4397 - RNA, 19 nt, Artificial Sequence
  Description of Artificial Sequence: Synthetic oligonucleotide
ggcgcuggguguauucgcc

SEQ ID NO: 4398 - RNA, 19 nt, Artificial Sequence
  Description of Artificial Sequence: Synthetic oligonucleotide
gcgcuggguguauucgccu

SEQ ID NO: 4399 - RNA, 19 nt, Artificial Sequence
  Description of Artificial Sequence: Synthetic oligonucleotide
cgcuggguguauucgccua

SEQ ID NO: 4400 - RNA, 19 nt, Artificial Sequence
  Description of Artificial Sequence: Synthetic oligonucleotide
gcuggguguauucgccuau

SEQ ID NO: 4401 - RNA, 19 nt, Artificial Sequence
  Description of Artificial Sequence: Synthetic oligonucleotide
cuggguguauucgccuaug

SEQ ID NO: 4402 - RNA, 19 nt, Artificial Sequence
  Description of Artificial Sequence: Synthetic oligonucleotide
uggguguauucgccuauga

SEQ ID NO: 4403 - RNA, 19 nt, Artificial Sequence
  Description of Artificial Sequence: Synthetic oligonucleotide
ggguguauucgccuaugaa

SEQ ID NO: 4404 - RNA, 19 nt, Artificial Sequence
  Description of Artificial Sequence: Synthetic oligonucleotide
gguguauucgccuaugaaa

SEQ ID NO: 4405 - RNA, 19 nt, Artificial Sequence
  Description of Artificial Sequence: Synthetic oligonucleotide
guguauucgccuaugaaau

SEQ ID NO: 4406 - RNA, 19 nt, Artificial Sequence
  Description of Artificial Sequence: Synthetic oligonucleotide
uguauucgccuaugaaaug

SEQ ID NO: 4407 - RNA, 19 nt, Artificial Sequence
  Description of Artificial Sequence: Synthetic oligonucleotide
guauucgccuaugaaaugu

SEQ ID NO: 4408 - RNA, 19 nt, Artificial Sequence
  Description of Artificial Sequence: Synthetic oligonucleotide
uauucgccuaugaaauguu

SEQ ID NO: 4409 - RNA, 19 nt, Artificial Sequence
  Description of Artificial Sequence: Synthetic oligonucleotide
auucgccuaugaaauguuc

SEQ ID NO: 4410 - RNA, 19 nt, Artificial Sequence
  Description of Artificial Sequence: Synthetic oligonucleotide
uucgccuaugaaauguucu

SEQ ID NO: 4411 - RNA, 19 nt, Artificial Sequence
  Description of Artificial Sequence: Synthetic oligonucleotide
ucgccuaugaaauguucua

SEQ ID NO: 4412 - RNA, 19 nt, Artificial Sequence
  Description of Artificial Sequence: Synthetic oligonucleotide
cgccuaugaaauguucuau

SEQ ID NO: 4413 - RNA, 19 nt, Artificial Sequence
  Description of Artificial Sequence: Synthetic oligonucleotide
gccuaugaaauguucuaug

SEQ ID NO: 4414 - RNA, 19 nt, Artificial Sequence
  Description of Artificial Sequence: Synthetic oligonucleotide
ccuaugaaauguucuaugg

SEQ ID NO: 4415 - RNA, 19 nt, Artificial Sequence
  Description of Artificial Sequence: Synthetic oligonucleotide
cuaugaaauguucuauggg

SEQ ID NO: 4416 - RNA, 19 nt, Artificial Sequence
  Description of Artificial Sequence: Synthetic oligonucleotide
uaugaaauguucuaugggc

SEQ ID NO: 4417 - RNA, 19 nt, Artificial Sequence
  Description of Artificial Sequence: Synthetic oligonucleotide
augaaauguucuaugggca

SEQ ID NO: 4418 - RNA, 19 nt, Artificial Sequence
  Description of Artificial Sequence: Synthetic oligonucleotide
ugaaauguucuaugggcag

SEQ ID NO: 4419 - RNA, 19 nt, Artificial Sequence
  Description of Artificial Sequence: Synthetic oligonucleotide
gaaauguucuaugggcaga

SEQ ID NO: 4420 - RNA, 19 nt, Artificial Sequence
  Description of Artificial Sequence: Synthetic oligonucleotide
aaauguucuaugggcagac

SEQ ID NO: 4421 - RNA, 19 nt, Artificial Sequence
  Description of Artificial Sequence: Synthetic oligonucleotide
aauguucuaugggcagacg

SEQ ID NO: 4422 - RNA, 19 nt, Artificial Sequence
  Description of Artificial Sequence: Synthetic oligonucleotide
auguucuaugggcagacgc

SEQ ID NO: 4423 - RNA, 19 nt, Artificial Sequence
  Description of Artificial Sequence: Synthetic oligonucleotide
uguucuaugggcagacgcc

SEQ ID NO: 4424 - RNA, 19 nt, Artificial Sequence
  Description of Artificial Sequence: Synthetic oligonucleotide
guucuaugggcagacgccc

SEQ ID NO: 4425 - RNA, 19 nt, Artificial Sequence
  Description of Artificial Sequence: Synthetic oligonucleotide
uucuaugggcagacgcccu

SEQ ID NO: 4426 - RNA, 19 nt, Artificial Sequence
  Description of Artificial Sequence: Synthetic oligonucleotide
ucuaugggcagacgcccuu

SEQ ID NO: 4427 - RNA, 19 nt, Artificial Sequence
  Description of Artificial Sequence: Synthetic oligonucleotide
cuaugggcagacgcccuuc

SEQ ID NO: 4428 - RNA, 19 nt, Artificial Sequence
  Description of Artificial Sequence: Synthetic oligonucleotide
uaugggcagacgcccuucu

SEQ ID NO: 4429 - RNA, 19 nt, Artificial Sequence
  Description of Artificial Sequence: Synthetic oligonucleotide
augggcagacgcccuucua

SEQ ID NO: 4430 - RNA, 19 nt, Artificial Sequence
  Description of Artificial Sequence: Synthetic oligonucleotide
ugggcagacgcccuucuac

SEQ ID NO: 4431 - RNA, 19 nt, Artificial Sequence
  Description of Artificial Sequence: Synthetic oligonucleotide
gggcagacgcccuucuacg

SEQ ID NO: 4432 - RNA, 19 nt, Artificial Sequence
  Description of Artificial Sequence: Synthetic oligonucleotide
ggcagacgcccuucuacgc

SEQ ID NO: 4433 - RNA, 19 nt, Artificial Sequence
  Description of Artificial Sequence: Synthetic oligonucleotide
gcagacgcccuucuacgcg

SEQ ID NO: 4434 - RNA, 19 nt, Artificial Sequence
  Description of Artificial Sequence: Synthetic oligonucleotide
cagacgcccuucuacgcgg

SEQ ID NO: 4435 - RNA, 19 nt, Artificial Sequence
  Description of Artificial Sequence: Synthetic oligonucleotide
agacgcccuucuacgcgga

SEQ ID NO: 4436 - RNA, 19 nt, Artificial Sequence
  Description of Artificial Sequence: Synthetic oligonucleotide
gacgcccuucuacgcggau

SEQ ID NO: 4437 - RNA, 19 nt, Artificial Sequence
  Description of Artificial Sequence: Synthetic oligonucleotide
acgcccuucuacgcggauu

SEQ ID NO: 4438 - RNA, 19 nt, Artificial Sequence
  Description of Artificial Sequence: Synthetic oligonucleotide
cgcccuucuacgcggauuc

SEQ ID NO: 4439 - RNA, 19 nt, Artificial Sequence
  Description of Artificial Sequence: Synthetic oligonucleotide
gcccuucuacgcggauucc

SEQ ID NO: 4440 - RNA, 19 nt, Artificial Sequence
  Description of Artificial Sequence: Synthetic oligonucleotide
cccuucuacgcggauucca

SEQ ID NO: 4441 - RNA, 19 nt, Artificial Sequence
  Description of Artificial Sequence: Synthetic oligonucleotide
ccuucuacgcggauuccac

SEQ ID NO: 4442 - RNA, 19 nt, Artificial Sequence
  Description of Artificial Sequence: Synthetic oligonucleotide
cuucuacgcggauuccacg

SEQ ID NO: 4443 - RNA, 19 nt, Artificial Sequence
  Description of Artificial Sequence: Synthetic oligonucleotide
uucuacgcggauuccacgg

SEQ ID NO: 4444 - RNA, 19 nt, Artificial Sequence
  Description of Artificial Sequence: Synthetic oligonucleotide
ucuacgcggauuccacggc

SEQ ID NO: 4445 - RNA, 19 nt, Artificial Sequence
  Description of Artificial Sequence: Synthetic oligonucleotide
cuacgcggauuccacggcg

SEQ ID NO: 4446 - RNA, 19 nt, Artificial Sequence
  Description of Artificial Sequence: Synthetic oligonucleotide
uacgcggauuccacggcgg

SEQ ID NO: 4447 - RNA, 19 nt, Artificial Sequence
  Description of Artificial Sequence: Synthetic oligonucleotide
acgcggauuccacggcgga

SEQ ID NO: 4448 - RNA, 19 nt, Artificial Sequence
  Description of Artificial Sequence: Synthetic oligonucleotide
cgcggauuccacggcggag

SEQ ID NO: 4449 - RNA, 19 nt, Artificial Sequence
  Description of Artificial Sequence: Synthetic oligonucleotide
gcggauuccacggcggaga

SEQ ID NO: 4450 - RNA, 19 nt, Artificial Sequence
  Description of Artificial Sequence: Synthetic oligonucleotide
cggauuccacggcggagac

SEQ ID NO: 4451 - RNA, 19 nt, Artificial Sequence
  Description of Artificial Sequence: Synthetic oligonucleotide
ggauuccacggcggagacc

SEQ ID NO: 4452 - RNA, 19 nt, Artificial Sequence
  Description of Artificial Sequence: Synthetic oligonucleotide
gauuccacggcggagaccu

SEQ ID NO: 4453 - RNA, 19 nt, Artificial Sequence
  Description of Artificial Sequence: Synthetic oligonucleotide
auuccacggcggagaccua

SEQ ID NO: 4454 - RNA, 19 nt, Artificial Sequence
  Description of Artificial Sequence: Synthetic oligonucleotide
uuccacggcggagaccuau

SEQ ID NO: 4455 - RNA, 19 nt, Artificial Sequence
  Description of Artificial Sequence: Synthetic oligonucleotide
uccacggcggagaccuaug

SEQ ID NO: 4456 - RNA, 19 nt, Artificial Sequence
  Description of Artificial Sequence: Synthetic oligonucleotide
ccacggcggagaccuaugg

SEQ ID NO: 4457 - RNA, 19 nt, Artificial Sequence
  Description of Artificial Sequence: Synthetic oligonucleotide
cacggcggagaccuauggc

SEQ ID NO: 4458 - RNA, 19 nt, Artificial Sequence
  Description of Artificial Sequence: Synthetic oligonucleotide
acggcggagaccuauggca

SEQ ID NO: 4459 - RNA, 19 nt, Artificial Sequence
  Description of Artificial Sequence: Synthetic oligonucleotide
cggcggagaccuauggcaa

SEQ ID NO: 4460 - RNA, 19 nt, Artificial Sequence
  Description of Artificial Sequence: Synthetic oligonucleotide
ggcggagaccuauggcaag

SEQ ID NO: 4461 - RNA, 19 nt, Artificial Sequence
  Description of Artificial Sequence: Synthetic oligonucleotide
gcggagaccuauggcaaga

SEQ ID NO: 4462 - RNA, 19 nt, Artificial Sequence
  Description of Artificial Sequence: Synthetic oligonucleotide
cggagaccuauggcaagau

SEQ ID NO: 4463 - RNA, 19 nt, Artificial Sequence
  Description of Artificial Sequence: Synthetic oligonucleotide
ggagaccuauggcaagauc

SEQ ID NO: 4464 - RNA, 19 nt, Artificial Sequence
  Description of Artificial Sequence: Synthetic oligonucleotide
gagaccuauggcaagaucg

SEQ ID NO: 4465 - RNA, 19 nt, Artificial Sequence
  Description of Artificial Sequence: Synthetic oligonucleotide
agaccuauggcaagaucgu

SEQ ID NO: 4466 - RNA, 19 nt, Artificial Sequence
  Description of Artificial Sequence: Synthetic oligonucleotide
gaccuauggcaagaucguc

SEQ ID NO: 4467 - RNA, 19 nt, Artificial Sequence
  Description of Artificial Sequence: Synthetic oligonucleotide
accuauggcaagaucgucc

SEQ ID NO: 4468 - RNA, 19 nt, Artificial Sequence
  Description of Artificial Sequence: Synthetic oligonucleotide
ccuauggcaagaucgucca

SEQ ID NO: 4469 - RNA, 19 nt, Artificial Sequence
  Description of Artificial Sequence: Synthetic oligonucleotide
cuauggcaagaucguccac

SEQ ID NO: 4470 - RNA, 19 nt, Artificial Sequence
  Description of Artificial Sequence: Synthetic oligonucleotide
uauggcaagaucguccacu

SEQ ID NO: 4471 - RNA, 19 nt, Artificial Sequence
  Description of Artificial Sequence: Synthetic oligonucleotide
auggcaagaucguccacua

SEQ ID NO: 4472 - RNA, 19 nt, Artificial Sequence
  Description of Artificial Sequence: Synthetic oligonucleotide
uggcaagaucguccacuac

SEQ ID NO: 4473 - RNA, 19 nt, Artificial Sequence
  Description of Artificial Sequence: Synthetic oligonucleotide
ggcaagaucguccacuaca

SEQ ID NO: 4474 - RNA, 19 nt, Artificial Sequence
  Description of Artificial Sequence: Synthetic oligonucleotide
gcaagaucguccacuacaa

SEQ ID NO: 4475 - RNA, 19 nt, Artificial Sequence
  Description of Artificial Sequence: Synthetic oligonucleotide
caagaucguccacuacaag

SEQ ID NO: 4476 - RNA, 19 nt, Artificial Sequence
  Description of Artificial Sequence: Synthetic oligonucleotide
aagaucguccacuacaagg

SEQ ID NO: 4477 - RNA, 19 nt, Artificial Sequence
  Description of Artificial Sequence: Synthetic oligonucleotide
agaucguccacuacaagga

SEQ ID NO: 4478 - RNA, 19 nt, Artificial Sequence
  Description of Artificial Sequence: Synthetic oligonucleotide
gaucguccacuacaaggag

SEQ ID NO: 4479 - RNA, 19 nt, Artificial Sequence
  Description of Artificial Sequence: Synthetic oligonucleotide
aucguccacuacaaggagc

SEQ ID NO: 4480 - RNA, 19 nt, Artificial Sequence
  Description of Artificial Sequence: Synthetic oligonucleotide
ucguccacuacaaggagca

SEQ ID NO: 4481 - RNA, 19 nt, Artificial Sequence
  Description of Artificial Sequence: Synthetic oligonucleotide
cguccacuacaaggagcac

SEQ ID NO: 4482 - RNA, 19 nt, Artificial Sequence
  Description of Artificial Sequence: Synthetic oligonucleotide
guccacuacaaggagcacc

SEQ ID NO: 4483 - RNA, 19 nt, Artificial Sequence
  Description of Artificial Sequence: Synthetic oligonucleotide
uccacuacaaggagcaccu

SEQ ID NO: 4484 - RNA, 19 nt, Artificial Sequence
  Description of Artificial Sequence: Synthetic oligonucleotide
ccacuacaaggagcaccuc

SEQ ID NO: 4485 - RNA, 19 nt, Artificial Sequence
  Description of Artificial Sequence: Synthetic oligonucleotide
cacuacaaggagcaccucu

SEQ ID NO: 4486 - RNA, 19 nt, Artificial Sequence
  Description of Artificial Sequence: Synthetic oligonucleotide
acuacaaggagcaccucuc

SEQ ID NO: 4487 - RNA, 19 nt, Artificial Sequence
  Description of Artificial Sequence: Synthetic oligonucleotide
cuacaaggagcaccucucu

SEQ ID NO: 4488 - RNA, 19 nt, Artificial Sequence
  Description of Artificial Sequence: Synthetic oligonucleotide
uacaaggagcaccucucuc

SEQ ID NO: 4489 - RNA, 19 nt, Artificial Sequence
  Description of Artificial Sequence: Synthetic oligonucleotide
acaaggagcaccucucucu

SEQ ID NO: 4490 - RNA, 19 nt, Artificial Sequence
  Description of Artificial Sequence: Synthetic oligonucleotide
caaggagcaccucucucug

SEQ ID NO: 4491 - RNA, 19 nt, Artificial Sequence
  Description of Artificial Sequence: Synthetic oligonucleotide
aaggagcaccucucucugc

SEQ ID NO: 4492 - RNA, 19 nt, Artificial Sequence
  Description of Artificial Sequence: Synthetic oligonucleotide
aggagcaccucucucugcc

SEQ ID NO: 4493 - RNA, 19 nt, Artificial Sequence
  Description of Artificial Sequence: Synthetic oligonucleotide
ggagcaccucucucugccg

SEQ ID NO: 4494 - RNA, 19 nt, Artificial Sequence
  Description of Artificial Sequence: Synthetic oligonucleotide
gagcaccucucucugccgc

SEQ ID NO: 4495 - RNA, 19 nt, Artificial Sequence
  Description of Artificial Sequence: Synthetic oligonucleotide
agcaccucucucugccgcu

SEQ ID NO: 4496 - RNA, 19 nt, Artificial Sequence
  Description of Artificial Sequence: Synthetic oligonucleotide
gcaccucucucugccgcug

SEQ ID NO: 4497 - RNA, 19 nt, Artificial Sequence
  Description of Artificial Sequence: Synthetic oligonucleotide
caccucucucugccgcugg

SEQ ID NO: 4498 - RNA, 19 nt, Artificial Sequence
  Description of Artificial Sequence: Synthetic oligonucleotide
accucucucugccgcuggu

SEQ ID NO: 4499 - RNA, 19 nt, Artificial Sequence
  Description of Artificial Sequence: Synthetic oligonucleotide
ccucucucugccgcuggug

SEQ ID NO: 4500 - RNA, 19 nt, Artificial Sequence
  Description of Artificial Sequence: Synthetic oligonucleotide
cucucucugccgcuggugg

SEQ ID NO: 4501 - RNA, 19 nt, Artificial Sequence
  Description of Artificial Sequence: Synthetic oligonucleotide
ucucucugccgcuggugga

SEQ ID NO: 4502 - RNA, 19 nt, Artificial Sequence
  Description of Artificial Sequence: Synthetic oligonucleotide
cucucugccgcugguggac

SEQ ID NO: 4503 - RNA, 19 nt, Artificial Sequence
  Description of Artificial Sequence: Synthetic oligonucleotide
ucucugccgcugguggacg

SEQ ID NO: 4504 - RNA, 19 nt, Artificial Sequence
  Description of Artificial Sequence: Synthetic oligonucleotide
cucugccgcugguggacga

SEQ ID NO: 4505 - RNA, 19 nt, Artificial Sequence
  Description of Artificial Sequence: Synthetic oligonucleotide
ucugccgcugguggacgaa

SEQ ID NO: 4506 - RNA, 19 nt, Artificial Sequence
  Description of Artificial Sequence: Synthetic oligonucleotide
cugccgcugguggacgaag

SEQ ID NO: 4507 - RNA, 19 nt, Artificial Sequence
  Description of Artificial Sequence: Synthetic oligonucleotide
ugccgcugguggacgaagg

SEQ ID NO: 4508 - RNA, 19 nt, Artificial Sequence
  Description of Artificial Sequence: Synthetic oligonucleotide
gccgcugguggacgaaggg

SEQ ID NO: 4509 - RNA, 19 nt, Artificial Sequence
  Description of Artificial Sequence: Synthetic oligonucleotide
ccgcugguggacgaagggg

SEQ ID NO: 4510 - RNA, 19 nt, Artificial Sequence
  Description of Artificial Sequence: Synthetic oligonucleotide
cgcugguggacgaaggggu

SEQ ID NO: 4511 - RNA, 19 nt, Artificial Sequence
  Description of Artificial Sequence: Synthetic oligonucleotide
gcugguggacgaagggguc

SEQ ID NO: 4512 - RNA, 19 nt, Artificial Sequence
  Description of Artificial Sequence: Synthetic oligonucleotide
cugguggacgaaggggucc

SEQ ID NO: 4513 - RNA, 19 nt, Artificial Sequence
  Description of Artificial Sequence: Synthetic oligonucleotide
ugguggacgaagggguccc

SEQ ID NO: 4514 - RNA, 19 nt, Artificial Sequence
  Description of Artificial Sequence: Synthetic oligonucleotide
gguggacgaaggggucccu

SEQ ID NO: 4515 - RNA, 19 nt, Artificial Sequence
  Description of Artificial Sequence: Synthetic oligonucleotide
guggacgaaggggucccug

SEQ ID NO: 4516 - RNA, 19 nt, Artificial Sequence
  Description of Artificial Sequence: Synthetic oligonucleotide
uggacgaaggggucccuga

SEQ ID NO: 4517 - RNA, 19 nt, Artificial Sequence
  Description of Artificial Sequence: Synthetic oligonucleotide
ggacgaaggggucccugag

SEQ ID NO: 4518 - RNA, 19 nt, Artificial Sequence
  Description of Artificial Sequence: Synthetic oligonucleotide
gacgaaggggucccugagg

SEQ ID NO: 4519 - RNA, 19 nt, Artificial Sequence
  Description of Artificial Sequence: Synthetic oligonucleotide
acgaaggggucccugagga

SEQ ID NO: 4520 - RNA, 19 nt, Artificial Sequence
  Description of Artificial Sequence: Synthetic oligonucleotide
cgaaggggucccugaggag

SEQ ID NO: 4521 - RNA, 19 nt, Artificial Sequence
  Description of Artificial Sequence: Synthetic oligonucleotide
gaaggggucccugaggagg

SEQ ID NO: 4522 - RNA, 19 nt, Artificial Sequence
  Description of Artificial Sequence: Synthetic oligonucleotide
aaggggucccugaggaggc

SEQ ID NO: 4523 - RNA, 19 nt, Artificial Sequence
  Description of Artificial Sequence: Synthetic oligonucleotide
aggggucccugaggaggcu

SEQ ID NO: 4524 - RNA, 19 nt, Artificial Sequence
  Description of Artificial Sequence: Synthetic oligonucleotide
ggggucccugaggaggcuc

SEQ ID NO: 4525 - RNA, 19 nt, Artificial Sequence
  Description of Artificial Sequence: Synthetic oligonucleotide
gggucccugaggaggcucg

SEQ ID NO: 4526 - RNA, 19 nt, Artificial Sequence
  Description of Artificial Sequence: Synthetic oligonucleotide
ggucccugaggaggcucga

SEQ ID NO: 4527 - RNA, 19 nt, Artificial Sequence
  Description of Artificial Sequence: Synthetic oligonucleotide
gucccugaggaggcucgag

SEQ ID NO: 4528 - RNA, 19 nt, Artificial Sequence
  Description of Artificial Sequence: Synthetic oligonucleotide
ucccugaggaggcucgaga

SEQ ID NO: 4529 - RNA, 19 nt, Artificial Sequence
  Description of Artificial Sequence: Synthetic oligonucleotide
cccugaggaggcucgagac

SEQ ID NO: 4530 - RNA, 19 nt, Artificial Sequence
  Description of Artificial Sequence: Synthetic oligonucleotide
ccugaggaggcucgagacu

SEQ ID NO: 4531 - RNA, 19 nt, Artificial Sequence
  Description of Artificial Sequence: Synthetic oligonucleotide
cugaggaggcucgagacuu

SEQ ID NO: 4532 - RNA, 19 nt, Artificial Sequence
  Description of Artificial Sequence: Synthetic oligonucleotide
ugaggaggcucgagacuuc

SEQ ID NO: 4533 - RNA, 19 nt, Artificial Sequence
  Description of Artificial Sequence: Synthetic oligonucleotide
gaggaggcucgagacuuca

SEQ ID NO: 4534 - RNA, 19 nt, Artificial Sequence
  Description of Artificial Sequence: Synthetic oligonucleotide
aggaggcucgagacuucau

SEQ ID NO: 4535 - RNA, 19 nt, Artificial Sequence
  Description of Artificial Sequence: Synthetic oligonucleotide
ggaggcucgagacuucauu

SEQ ID NO: 4536 - RNA, 19 nt, Artificial Sequence
  Description of Artificial Sequence: Synthetic oligonucleotide
gaggcucgagacuucauuc

SEQ ID NO: 4537 - RNA, 19 nt, Artificial Sequence
  Description of Artificial Sequence: Synthetic oligonucleotide
aggcucgagacuucauuca

SEQ ID NO: 4538 - RNA, 19 nt, Artificial Sequence
  Description of Artificial Sequence: Synthetic oligonucleotide
ggcucgagacuucauucag

SEQ ID NO: 4539 - RNA, 19 nt, Artificial Sequence
  Description of Artificial Sequence: Synthetic oligonucleotide
gcucgagacuucauucagc

SEQ ID NO: 4540 - RNA, 19 nt, Artificial Sequence
  Description of Artificial Sequence: Synthetic oligonucleotide
cucgagacuucauucagcg

SEQ ID NO: 4541 - RNA, 19 nt, Artificial Sequence
  Description of Artificial Sequence: Synthetic oligonucleotide
ucgagacuucauucagcgg

SEQ ID NO: 4542 - RNA, 19 nt, Artificial Sequence
  Description of Artificial Sequence: Synthetic oligonucleotide
cgagacuucauucagcggu

SEQ ID NO: 4543 - RNA, 19 nt, Artificial Sequence
  Description of Artificial Sequence: Synthetic oligonucleotide
gagacuucauucagcgguu

SEQ ID NO: 4544 - RNA, 19 nt, Artificial Sequence
  Description of Artificial Sequence: Synthetic oligonucleotide
agacuucauucagcgguug

SEQ ID NO: 4545 - RNA, 19 nt, Artificial Sequence
  Description of Artificial Sequence: Synthetic oligonucleotide
gacuucauucagcgguugc

SEQ ID NO: 4546 - RNA, 19 nt, Artificial Sequence
  Description of Artificial Sequence: Synthetic oligonucleotide
acuucauucagcgguugcu

SEQ ID NO: 4547 - RNA, 19 nt, Artificial Sequence
  Description of Artificial Sequence: Synthetic oligonucleotide
cuucauucagcgguugcug

SEQ ID NO: 4548 - RNA, 19 nt, Artificial Sequence
  Description of Artificial Sequence: Synthetic oligonucleotide
uucauucagcgguugcugu

SEQ ID NO: 4549 - RNA, 19 nt, Artificial Sequence
  Description of Artificial Sequence: Synthetic oligonucleotide
ucauucagcgguugcugug

SEQ ID NO: 4550 - RNA, 19 nt, Artificial Sequence
  Description of Artificial Sequence: Synthetic oligonucleotide
cauucagcgguugcugugu

SEQ ID NO: 4551 - RNA, 19 nt, Artificial Sequence
  Description of Artificial Sequence: Synthetic oligonucleotide
auucagcgguugcuguguc

SEQ ID NO: 4552 - RNA, 19 nt, Artificial Sequence
  Description of Artificial Sequence: Synthetic oligonucleotide
uucagcgguugcugugucc

SEQ ID NO: 4553 - RNA, 19 nt, Artificial Sequence
  Description of Artificial Sequence: Synthetic oligonucleotide
ucagcgguugcuguguccc

SEQ ID NO: 4554 - RNA, 19 nt, Artificial Sequence
  Description of Artificial Sequence: Synthetic oligonucleotide
cagcgguugcugugucccc

SEQ ID NO: 4555 - RNA, 19 nt, Artificial Sequence
  Description of Artificial Sequence: Synthetic oligonucleotide
agcgguugcuguguccccc

SEQ ID NO: 4556 - RNA, 19 nt, Artificial Sequence
  Description of Artificial Sequence: Synthetic oligonucleotide
gcgguugcugugucccccg

SEQ ID NO: 4557 - RNA, 19 nt, Artificial Sequence
  Description of Artificial Sequence: Synthetic oligonucleotide
cgguugcugugucccccgg

SEQ ID NO: 4558 - RNA, 19 nt, Artificial Sequence
  Description of Artificial Sequence: Synthetic oligonucleotide
gguugcugugucccccgga

SEQ ID NO: 4559 - RNA, 19 nt, Artificial Sequence
  Description of Artificial Sequence: Synthetic oligonucleotide
guugcugugucccccggag

SEQ ID NO: 4560 - RNA, 19 nt, Artificial Sequence
  Description of Artificial Sequence: Synthetic oligonucleotide
uugcugugucccccggaga

SEQ ID NO: 4561 - RNA, 19 nt, Artificial Sequence
  Description of Artificial Sequence: Synthetic oligonucleotide
ugcugugucccccggagac

SEQ ID NO: 4562 - RNA, 19 nt, Artificial Sequence
  Description of Artificial Sequence: Synthetic oligonucleotide
gcugugucccccggagaca

SEQ ID NO: 4563 - RNA, 19 nt, Artificial Sequence
  Description of Artificial Sequence: Synthetic oligonucleotide
cugugucccccggagacac

SEQ ID NO: 4564 - RNA, 19 nt, Artificial Sequence
  Description of Artificial Sequence: Synthetic oligonucleotide
ugugucccccggagacacg

SEQ ID NO: 4565 - RNA, 19 nt, Artificial Sequence
  Description of Artificial Sequence: Synthetic oligonucleotide
gugucccccggagacacgg

SEQ ID NO: 4566 - RNA, 19 nt, Artificial Sequence
  Description of Artificial Sequence: Synthetic oligonucleotide
ugucccccggagacacggc

SEQ ID NO: 4567 - RNA, 19 nt, Artificial Sequence
  Description of Artificial Sequence: Synthetic oligonucleotide
gucccccggagacacggcu

SEQ ID NO: 4568 - RNA, 19 nt, Artificial Sequence
  Description of Artificial Sequence: Synthetic oligonucleotide
ucccccggagacacggcug

SEQ ID NO: 4569 - RNA, 19 nt, Artificial Sequence
  Description of Artificial Sequence: Synthetic oligonucleotide
cccccggagacacggcugg

SEQ ID NO: 4570 - RNA, 19 nt, Artificial Sequence
  Description of Artificial Sequence: Synthetic oligonucleotide
ccccggagacacggcuggg

SEQ ID NO: 4571 - RNA, 19 nt, Artificial Sequence
  Description of Artificial Sequence: Synthetic oligonucleotide
cccggagacacggcugggc

SEQ ID NO: 4572 - RNA, 19 nt, Artificial Sequence
  Description of Artificial Sequence: Synthetic oligonucleotide
ccggagacacggcugggcc

SEQ ID NO: 4573 - RNA, 19 nt, Artificial Sequence
  Description of Artificial Sequence: Synthetic oligonucleotide
cggagacacggcugggccg

SEQ ID NO: 4574 - RNA, 19 nt, Artificial Sequence
  Description of Artificial Sequence: Synthetic oligonucleotide
ggagacacggcugggccgg

SEQ ID NO: 4575 - RNA, 19 nt, Artificial Sequence
  Description of Artificial Sequence: Synthetic oligonucleotide
gagacacggcugggccggg

SEQ ID NO: 4576 - RNA, 19 nt, Artificial Sequence
  Description of Artificial Sequence: Synthetic oligonucleotide
agacacggcugggccgggg

SEQ ID NO: 4577 - RNA, 19 nt, Artificial Sequence
  Description of Artificial Sequence: Synthetic oligonucleotide
gacacggcugggccggggu

SEQ ID NO: 4578 - RNA, 19 nt, Artificial Sequence
  Description of Artificial Sequence: Synthetic oligonucleotide
acacggcugggccggggug

SEQ ID NO: 4579 - RNA, 19 nt, Artificial Sequence
  Description of Artificial Sequence: Synthetic oligonucleotide
cacggcugggccggggugg

SEQ ID NO: 4580 - RNA, 19 nt, Artificial Sequence
  Description of Artificial Sequence: Synthetic oligonucleotide
acggcugggccggggugga

SEQ ID NO: 4581 - RNA, 19 nt, Artificial Sequence
  Description of Artificial Sequence: Synthetic oligonucleotide
cggcugggccgggguggag

SEQ ID NO: 4582 - RNA, 19 nt, Artificial Sequence
  Description of Artificial Sequence: Synthetic oligonucleotide
ggcugggccgggguggagc

SEQ ID NO: 4583 - RNA, 19 nt, Artificial Sequence
  Description of Artificial Sequence: Synthetic oligonucleotide
gcugggccgggguggagca

SEQ ID NO: 4584 - RNA, 19 nt, Artificial Sequence
  Description of Artificial Sequence: Synthetic oligonucleotide
cugggccgggguggagcag

SEQ ID NO: 4585 - RNA, 19 nt, Artificial Sequence
  Description of Artificial Sequence: Synthetic oligonucleotide
ugggccgggguggagcagg

SEQ ID NO: 4586 - RNA, 19 nt, Artificial Sequence
  Description of Artificial Sequence: Synthetic oligonucleotide
gggccgggguggagcaggc

SEQ ID NO: 4587 - RNA, 19 nt, Artificial Sequence
  Description of Artificial Sequence: Synthetic oligonucleotide
ggccgggguggagcaggcg

SEQ ID NO: 4588 - RNA, 19 nt, Artificial Sequence
  Description of Artificial Sequence: Synthetic oligonucleotide
gccgggguggagcaggcga

SEQ ID NO: 4589 - RNA, 19 nt, Artificial Sequence
  Description of Artificial Sequence: Synthetic oligonucleotide
ccgggguggagcaggcgac

SEQ ID NO: 4590 - RNA, 19 nt, Artificial Sequence
  Description of Artificial Sequence: Synthetic oligonucleotide
cgggguggagcaggcgacu

SEQ ID NO: 4591 - RNA, 19 nt, Artificial Sequence
  Description of Artificial Sequence: Synthetic oligonucleotide
gggguggagcaggcgacuu

SEQ ID NO: 4592 - RNA, 19 nt, Artificial Sequence
  Description of Artificial Sequence: Synthetic oligonucleotide
ggguggagcaggcgacuuc

SEQ ID NO: 4593 - RNA, 19 nt, Artificial Sequence
  Description of Artificial Sequence: Synthetic oligonucleotide
gguggagcaggcgacuucc

SEQ ID NO: 4594 - RNA, 19 nt, Artificial Sequence
  Description of Artificial Sequence: Synthetic oligonucleotide
guggagcaggcgacuuccg

SEQ ID NO: 4595 - RNA, 19 nt, Artificial Sequence
  Description of Artificial Sequence: Synthetic oligonucleotide
uggagcaggcgacuuccgg

SEQ ID NO: 4596 - RNA, 19 nt, Artificial Sequence
  Description of Artificial Sequence: Synthetic oligonucleotide
ggagcaggcgacuuccgga

SEQ ID NO: 4597 - RNA, 19 nt, Artificial Sequence
  Description of Artificial Sequence: Synthetic oligonucleotide
gagcaggcgacuuccggac

SEQ ID NO: 4598 - RNA, 19 nt, Artificial Sequence
  Description of Artificial Sequence: Synthetic oligonucleotide
agcaggcgacuuccggaca

SEQ ID NO: 4599 - RNA, 19 nt, Artificial Sequence
  Description of Artificial Sequence: Synthetic oligonucleotide
gcaggcgacuuccggacac

SEQ ID NO: 4600 - RNA, 19 nt, Artificial Sequence
  Description of Artificial Sequence: Synthetic oligonucleotide
caggcgacuuccggacaca

SEQ ID NO: 4601 - RNA, 19 nt, Artificial Sequence
  Description of Artificial Sequence: Synthetic oligonucleotide
aggcgacuuccggacacau

SEQ ID NO: 4602 - RNA, 19 nt, Artificial Sequence
  Description of Artificial Sequence: Synthetic oligonucleotide
ggcgacuuccggacacauc

SEQ ID NO: 4603 - RNA, 19 nt, Artificial Sequence
  Description of Artificial Sequence: Synthetic oligonucleotide
gcgacuuccggacacaucc

SEQ ID NO: 4604 - RNA, 19 nt, Artificial Sequence
  Description of Artificial Sequence: Synthetic oligonucleotide
cgacuuccggacacauccc

SEQ ID NO: 4605 - RNA, 19 nt, Artificial Sequence
  Description of Artificial Sequence: Synthetic oligonucleotide
gacuuccggacacaucccu

SEQ ID NO: 4606 - RNA, 19 nt, Artificial Sequence
  Description of Artificial Sequence: Synthetic oligonucleotide
acuuccggacacaucccuu

SEQ ID NO: 4607 - RNA, 19 nt, Artificial Sequence
  Description of Artificial Sequence: Synthetic oligonucleotide
cuuccggacacaucccuuc

SEQ ID NO: 4608 - RNA, 19 nt, Artificial Sequence
  Description of Artificial Sequence: Synthetic oligonucleotide
uuccggacacaucccuucu

SEQ ID NO: 4609 - RNA, 19 nt, Artificial Sequence
  Description of Artificial Sequence: Synthetic oligonucleotide
uccggacacaucccuucuu

SEQ ID NO: 4610 - RNA, 19 nt, Artificial Sequence
  Description of Artificial Sequence: Synthetic oligonucleotide
ccggacacaucccuucuuc

SEQ ID NO: 4611 - RNA, 19 nt, Artificial Sequence
  Description of Artificial Sequence: Synthetic oligonucleotide
cggacacaucccuucuucu

SEQ ID NO: 4612 - RNA, 19 nt, Artificial Sequence
  Description of Artificial Sequence: Synthetic oligonucleotide
ggacacaucccuucuucuu

SEQ ID NO: 4613 - RNA, 19 nt, Artificial Sequence
  Description of Artificial Sequence: Synthetic oligonucleotide
gacacaucccuucuucuuu

SEQ ID NO: 4614 - RNA, 19 nt, Artificial Sequence
  Description of Artificial Sequence: Synthetic oligonucleotide
acacaucccuucuucuuug

SEQ ID NO: 4615 - RNA, 19 nt, Artificial Sequence
  Description of Artificial Sequence: Synthetic oligonucleotide
cacaucccuucuucuuugg

SEQ ID NO: 4616 - RNA, 19 nt, Artificial Sequence
  Description of Artificial Sequence: Synthetic oligonucleotide
acaucccuucuucuuuggc

SEQ ID NO: 4617 - RNA, 19 nt, Artificial Sequence
  Description of Artificial Sequence: Synthetic oligonucleotide
caucccuucuucuuuggcc

SEQ ID NO: 4618 - RNA, 19 nt, Artificial Sequence
  Description of Artificial Sequence: Synthetic oligonucleotide
aucccuucuucuuuggccu

SEQ ID NO: 4619 - RNA, 19 nt, Artificial Sequence
  Description of Artificial Sequence: Synthetic oligonucleotide
ucccuucuucuuuggccuc

SEQ ID NO: 4620 - RNA, 19 nt, Artificial Sequence
  Description of Artificial Sequence: Synthetic oligonucleotide
cccuucuucuuuggccucg

SEQ ID NO: 4621 - RNA, 19 nt, Artificial Sequence
  Description of Artificial Sequence: Synthetic oligonucleotide
ccuucuucuuuggccucga

SEQ ID NO: 4622 - RNA, 19 nt, Artificial Sequence
  Description of Artificial Sequence: Synthetic oligonucleotide
cuucuucuuuggccucgac

SEQ ID NO: 4623 - RNA, 19 nt, Artificial Sequence
  Description of Artificial Sequence: Synthetic oligonucleotide
uucuucuuuggccucgacu

SEQ ID NO: 4624 - RNA, 19 nt, Artificial Sequence
  Description of Artificial Sequence: Synthetic oligonucleotide
ucuucuuuggccucgacug

SEQ ID NO: 4625 - RNA, 19 nt, Artificial Sequence
  Description of Artificial Sequence: Synthetic oligonucleotide
cuucuuuggccucgacugg

SEQ ID NO: 4626 - RNA, 19 nt, Artificial Sequence
  Description of Artificial Sequence: Synthetic oligonucleotide
uucuuuggccucgacuggg

SEQ ID NO: 4627 - RNA, 19 nt, Artificial Sequence
  Description of Artificial Sequence: Synthetic oligonucleotide
ucuuuggccucgacuggga

SEQ ID NO: 4628 - RNA, 19 nt, Artificial Sequence
  Description of Artificial Sequence: Synthetic oligonucleotide
cuuuggccucgacugggau

SEQ ID NO: 4629 - RNA, 19 nt, Artificial Sequence
  Description of Artificial Sequence: Synthetic oligonucleotide
uuuggccucgacugggaug

SEQ ID NO: 4630 - RNA, 19 nt, Artificial Sequence
  Description of Artificial Sequence: Synthetic oligonucleotide
uuggccucgacugggaugg

SEQ ID NO: 4631 - RNA, 19 nt, Artificial Sequence
  Description of Artificial Sequence: Synthetic oligonucleotide
uggccucgacugggauggu

SEQ ID NO: 4632 - RNA, 19 nt, Artificial Sequence
  Description of Artificial Sequence: Synthetic oligonucleotide
ggccucgacugggaugguc

SEQ ID NO: 4633 - RNA, 19 nt, Artificial Sequence
  Description of Artificial Sequence: Synthetic oligonucleotide
gccucgacugggauggucu

SEQ ID NO: 4634 - RNA, 19 nt, Artificial Sequence
  Description of Artificial Sequence: Synthetic oligonucleotide
ccucgacugggauggucuc

SEQ ID NO: 4635 - RNA, 19 nt, Artificial Sequence
  Description of Artificial Sequence: Synthetic oligonucleotide
cucgacugggauggucucc

SEQ ID NO: 4636 - RNA, 19 nt, Artificial Sequence
  Description of Artificial Sequence: Synthetic oligonucleotide
ucgacugggauggucuccg

SEQ ID NO: 4637 - RNA, 19 nt, Artificial Sequence
  Description of Artificial Sequence: Synthetic oligonucleotide
cgacugggauggucuccgg

SEQ ID NO: 4638 - RNA, 19 nt, Artificial Sequence
  Description of Artificial Sequence: Synthetic oligonucleotide
gacugggauggucuccggg

SEQ ID NO: 4639 - RNA, 19 nt, Artificial Sequence
  Description of Artificial Sequence: Synthetic oligonucleotide
acugggauggucuccggga

SEQ ID NO: 4640 - RNA, 19 nt, Artificial Sequence
  Description of Artificial Sequence: Synthetic oligonucleotide
cugggauggucuccgggac

SEQ ID NO: 4641 - RNA, 19 nt, Artificial Sequence
  Description of Artificial Sequence: Synthetic oligonucleotide
ugggauggucuccgggaca

SEQ ID NO: 4642 - RNA, 19 nt, Artificial Sequence
  Description of Artificial Sequence: Synthetic oligonucleotide
gggauggucuccgggacag

SEQ ID NO: 4643 - RNA, 19 nt, Artificial Sequence
  Description of Artificial Sequence: Synthetic oligonucleotide
ggauggucuccgggacagc

SEQ ID NO: 4644 - RNA, 19 nt, Artificial Sequence
  Description of Artificial Sequence: Synthetic oligonucleotide
gauggucuccgggacagcg

SEQ ID NO: 4645 - RNA, 19 nt, Artificial Sequence
  Description of Artificial Sequence: Synthetic oligonucleotide
auggucuccgggacagcgu

SEQ ID NO: 4646 - RNA, 19 nt, Artificial Sequence
  Description of Artificial Sequence: Synthetic oligonucleotide
uggucuccgggacagcgug

SEQ ID NO: 4647 - RNA, 19 nt, Artificial Sequence
  Description of Artificial Sequence: Synthetic oligonucleotide
ggucuccgggacagcgugc

SEQ ID NO: 4648 - RNA, 19 nt, Artificial Sequence
  Description of Artificial Sequence: Synthetic oligonucleotide
gucuccgggacagcgugcc

SEQ ID NO: 4649 - RNA, 19 nt, Artificial Sequence
  Description of Artificial Sequence: Synthetic oligonucleotide
ucuccgggacagcgugccc

SEQ ID NO: 4650 - RNA, 19 nt, Artificial Sequence
  Description of Artificial Sequence: Synthetic oligonucleotide
cuccgggacagcgugcccc

SEQ ID NO: 4651 - RNA, 19 nt, Artificial Sequence
  Description of Artificial Sequence: Synthetic oligonucleotide
uccgggacagcgugccccc

SEQ ID NO: 4652 - RNA, 19 nt, Artificial Sequence
  Description of Artificial Sequence: Synthetic oligonucleotide
ccgggacagcgugcccccc

SEQ ID NO: 4653 - RNA, 19 nt, Artificial Sequence
  Description of Artificial Sequence: Synthetic oligonucleotide
cgggacagcgugccccccu

SEQ ID NO: 4654 - RNA, 19 nt, Artificial Sequence
  Description of Artificial Sequence: Synthetic oligonucleotide
gggacagcgugccccccuu

SEQ ID NO: 4655 - RNA, 19 nt, Artificial Sequence
  Description of Artificial Sequence: Synthetic oligonucleotide
ggacagcgugccccccuuu

SEQ ID NO: 4656 - RNA, 19 nt, Artificial Sequence
  Description of Artificial Sequence: Synthetic oligonucleotide
gacagcgugccccccuuua

SEQ ID NO: 4657 - RNA, 19 nt, Artificial Sequence
  Description of Artificial Sequence: Synthetic oligonucleotide
acagcgugccccccuuuac

SEQ ID NO: 4658 - RNA, 19 nt, Artificial Sequence
  Description of Artificial Sequence: Synthetic oligonucleotide
cagcgugccccccuuuaca

SEQ ID NO: 4659 - RNA, 19 nt, Artificial Sequence
  Description of Artificial Sequence: Synthetic oligonucleotide
agcgugccccccuuuacac

SEQ ID NO: 4660 - RNA, 19 nt, Artificial Sequence
  Description of Artificial Sequence: Synthetic oligonucleotide
gcgugccccccuuuacacc

SEQ ID NO: 4661 - RNA, 19 nt, Artificial Sequence
  Description of Artificial Sequence: Synthetic oligonucleotide
cgugccccccuuuacaccg

SEQ ID NO: 4662 - RNA, 19 nt, Artificial Sequence
  Description of Artificial Sequence: Synthetic oligonucleotide
gugccccccuuuacaccgg

SEQ ID NO: 4663 - RNA, 19 nt, Artificial Sequence
  Description of Artificial Sequence: Synthetic oligonucleotide
ugccccccuuuacaccgga

SEQ ID NO: 4664 - RNA, 19 nt, Artificial Sequence
  Description of Artificial Sequence: Synthetic oligonucleotide
gccccccuuuacaccggau

SEQ ID NO: 4665 - RNA, 19 nt, Artificial Sequence
  Description of Artificial Sequence: Synthetic oligonucleotide
ccccccuuuacaccggauu

SEQ ID NO: 4666 - RNA, 19 nt, Artificial Sequence
  Description of Artificial Sequence: Synthetic oligonucleotide
cccccuuuacaccggauuu

SEQ ID NO: 4667 - RNA, 19 nt, Artificial Sequence
  Description of Artificial Sequence: Synthetic oligonucleotide
ccccuuuacaccggauuuc

SEQ ID NO: 4668 - RNA, 19 nt, Artificial Sequence
  Description of Artificial Sequence: Synthetic oligonucleotide
cccuuuacaccggauuucg

SEQ ID NO: 4669 - RNA, 19 nt, Artificial Sequence
  Description of Artificial Sequence: Synthetic oligonucleotide
ccuuuacaccggauuucga

SEQ ID NO: 4670 - RNA, 19 nt, Artificial Sequence
  Description of Artificial Sequence: Synthetic oligonucleotide
cuuuacaccggauuucgaa

SEQ ID NO: 4671 - RNA, 19 nt, Artificial Sequence
  Description of Artificial Sequence: Synthetic oligonucleotide
uuuacaccggauuucgaag

SEQ ID NO: 4672 - RNA, 19 nt, Artificial Sequence
  Description of Artificial Sequence: Synthetic oligonucleotide
uuacaccggauuucgaagg

SEQ ID NO: 4673 - RNA, 19 nt, Artificial Sequence
  Description of Artificial Sequence: Synthetic oligonucleotide
uacaccggauuucgaaggu

SEQ ID NO: 4674 - RNA, 19 nt, Artificial Sequence
  Description of Artificial Sequence: Synthetic oligonucleotide
acaccggauuucgaaggug

SEQ ID NO: 4675 - RNA, 19 nt, Artificial Sequence
  Description of Artificial Sequence: Synthetic oligonucleotide
caccggauuucgaaggugc

SEQ ID NO: 4676 - RNA, 19 nt, Artificial Sequence
  Description of Artificial Sequence: Synthetic oligonucleotide
accggauuucgaaggugcc

SEQ ID NO: 4677 - RNA, 19 nt, Artificial Sequence
  Description of Artificial Sequence: Synthetic oligonucleotide
ccggauuucgaaggugcca

SEQ ID NO: 4678 - RNA, 19 nt, Artificial Sequence
  Description of Artificial Sequence: Synthetic oligonucleotide
cggauuucgaaggugccac

SEQ ID NO: 4679 - RNA, 19 nt, Artificial Sequence
  Description of Artificial Sequence: Synthetic oligonucleotide
ggauuucgaaggugccacc

SEQ ID NO: 4680 - RNA, 19 nt, Artificial Sequence
  Description of Artificial Sequence: Synthetic oligonucleotide
gauuucgaaggugccaccg

SEQ ID NO: 4681 - RNA, 19 nt, Artificial Sequence
  Description of Artificial Sequence: Synthetic oligonucleotide
auuucgaaggugccaccga

SEQ ID NO: 4682 - RNA, 19 nt, Artificial Sequence
  Description of Artificial Sequence: Synthetic oligonucleotide
uuucgaaggugccaccgac

SEQ ID NO: 4683 - RNA, 19 nt, Artificial Sequence
  Description of Artificial Sequence: Synthetic oligonucleotide
uucgaaggugccaccgaca

SEQ ID NO: 4684 - RNA, 19 nt, Artificial Sequence
  Description of Artificial Sequence: Synthetic oligonucleotide
ucgaaggugccaccgacac

SEQ ID NO: 4685 - RNA, 19 nt, Artificial Sequence
  Description of Artificial Sequence: Synthetic oligonucleotide
cgaaggugccaccgacaca

SEQ ID NO: 4686 - RNA, 19 nt, Artificial Sequence
  Description of Artificial Sequence: Synthetic oligonucleotide
gaaggugccaccgacacau

SEQ ID NO: 4687 - RNA, 19 nt, Artificial Sequence
  Description of Artificial Sequence: Synthetic oligonucleotide
aaggugccaccgacacaug

SEQ ID NO: 4688 - RNA, 19 nt, Artificial Sequence
  Description of Artificial Sequence: Synthetic oligonucleotide
aggugccaccgacacaugc

SEQ ID NO: 4689 - RNA, 19 nt, Artificial Sequence
  Description of Artificial Sequence: Synthetic oligonucleotide
ggugccaccgacacaugca

SEQ ID NO: 4690 - RNA, 19 nt, Artificial Sequence
  Description of Artificial Sequence: Synthetic oligonucleotide
gugccaccgacacaugcaa

SEQ ID NO: 4691 - RNA, 19 nt, Artificial Sequence
  Description of Artificial Sequence: Synthetic oligonucleotide
ugccaccgacacaugcaac

SEQ ID NO: 4692 - RNA, 19 nt, Artificial Sequence
  Description of Artificial Sequence: Synthetic oligonucleotide
gccaccgacacaugcaacu

SEQ ID NO: 4693 - RNA, 19 nt, Artificial Sequence
  Description of Artificial Sequence: Synthetic oligonucleotide
ccaccgacacaugcaacuu

SEQ ID NO: 4694 - RNA, 19 nt, Artificial Sequence
  Description of Artificial Sequence: Synthetic oligonucleotide
caccgacacaugcaacuuc

SEQ ID NO: 4695 - RNA, 19 nt, Artificial Sequence
  Description of Artificial Sequence: Synthetic oligonucleotide
accgacacaugcaacuucg

SEQ ID NO: 4696 - RNA, 19 nt, Artificial Sequence
  Description of Artificial Sequence: Synthetic oligonucleotide
ccgacacaugcaacuucga

SEQ ID NO: 4697 - RNA, 19 nt, Artificial Sequence
  Description of Artificial Sequence: Synthetic oligonucleotide
cgacacaugcaacuucgac

SEQ ID NO: 4698 - RNA, 19 nt, Artificial Sequence
  Description of Artificial Sequence: Synthetic oligonucleotide
gacacaugcaacuucgacu

SEQ ID NO: 4699 - RNA, 19 nt, Artificial Sequence
  Description of Artificial Sequence: Synthetic oligonucleotide
acacaugcaacuucgacuu

SEQ ID NO: 4700 - RNA, 19 nt, Artificial Sequence
  Description of Artificial Sequence: Synthetic oligonucleotide
cacaugcaacuucgacuug

SEQ ID NO: 4701 - RNA, 19 nt, Artificial Sequence
  Description of Artificial Sequence: Synthetic oligonucleotide
acaugcaacuucgacuugg

SEQ ID NO: 4702 - RNA, 19 nt, Artificial Sequence
  Description of Artificial Sequence: Synthetic oligonucleotide
caugcaacuucgacuuggu

SEQ ID NO: 4703 - RNA, 19 nt, Artificial Sequence
  Description of Artificial Sequence: Synthetic oligonucleotide
augcaacuucgacuuggug

SEQ ID NO: 4704 - RNA, 19 nt, Artificial Sequence
  Description of Artificial Sequence: Synthetic oligonucleotide
ugcaacuucgacuuggugg

SEQ ID NO: 4705 - RNA, 19 nt, Artificial Sequence
  Description of Artificial Sequence: Synthetic oligonucleotide
gcaacuucgacuuggugga

SEQ ID NO: 4706 - RNA, 19 nt, Artificial Sequence
  Description of Artificial Sequence: Synthetic oligonucleotide
caacuucgacuugguggag

SEQ ID NO: 4707 - RNA, 19 nt, Artificial Sequence
  Description of Artificial Sequence: Synthetic oligonucleotide
aacuucgacuugguggagg

SEQ ID NO: 4708 - RNA, 19 nt, Artificial Sequence
  Description of Artificial Sequence: Synthetic oligonucleotide
acuucgacuugguggagga

SEQ ID NO: 4709 - RNA, 19 nt, Artificial Sequence
  Description of Artificial Sequence: Synthetic oligonucleotide
cuucgacuugguggaggac

SEQ ID NO: 4710 - RNA, 19 nt, Artificial Sequence
  Description of Artificial Sequence: Synthetic oligonucleotide
uucgacuugguggaggacg

SEQ ID NO: 4711 - RNA, 19 nt, Artificial Sequence
  Description of Artificial Sequence: Synthetic oligonucleotide
ucgacuugguggaggacgg

SEQ ID NO: 4712 - RNA, 19 nt, Artificial Sequence
  Description of Artificial Sequence: Synthetic oligonucleotide
cgacuugguggaggacggg

SEQ ID NO: 4713 - RNA, 19 nt, Artificial Sequence
  Description of Artificial Sequence: Synthetic oligonucleotide
gacuugguggaggacgggc

SEQ ID NO: 4714 - RNA, 19 nt, Artificial Sequence
  Description of Artificial Sequence: Synthetic oligonucleotide
acuugguggaggacgggcu

SEQ ID NO: 4715 - RNA, 19 nt, Artificial Sequence
  Description of Artificial Sequence: Synthetic oligonucleotide
cuugguggaggacgggcuc

SEQ ID NO: 4716 - RNA, 19 nt, Artificial Sequence
  Description of Artificial Sequence: Synthetic oligonucleotide
uugguggaggacgggcuca

SEQ ID NO: 4717 - RNA, 19 nt, Artificial Sequence
  Description of Artificial Sequence: Synthetic oligonucleotide
ugguggaggacgggcucac

SEQ ID NO: 4718 - RNA, 19 nt, Artificial Sequence
  Description of Artificial Sequence: Synthetic oligonucleotide
gguggaggacgggcucacu

SEQ ID NO: 4719 - RNA, 19 nt, Artificial Sequence
  Description of Artificial Sequence: Synthetic oligonucleotide
guggaggacgggcucacug

SEQ ID NO: 4720 - RNA, 19 nt, Artificial Sequence
  Description of Artificial Sequence: Synthetic oligonucleotide
uggaggacgggcucacugc

SEQ ID NO: 4721 - RNA, 19 nt, Artificial Sequence
  Description of Artificial Sequence: Synthetic oligonucleotide
ggaggacgggcucacugcc

SEQ ID NO: 4722 - RNA, 19 nt, Artificial Sequence
  Description of Artificial Sequence: Synthetic oligonucleotide
gaggacgggcucacugcca

SEQ ID NO: 4723 - RNA, 19 nt, Artificial Sequence
  Description of Artificial Sequence: Synthetic oligonucleotide
aggacgggcucacugccau

SEQ ID NO: 4724 - RNA, 19 nt, Artificial Sequence
  Description of Artificial Sequence: Synthetic oligonucleotide
ggacgggcucacugccaug

SEQ ID NO: 4725 - RNA, 19 nt, Artificial Sequence
  Description of Artificial Sequence: Synthetic oligonucleotide
gacgggcucacugccaugg

SEQ ID NO: 4726 - RNA, 19 nt, Artificial Sequence
  Description of Artificial Sequence: Synthetic oligonucleotide
acgggcucacugccaugga

SEQ ID NO: 4727 - RNA, 19 nt, Artificial Sequence
  Description of Artificial Sequence: Synthetic oligonucleotide
cgggcucacugccauggag

SEQ ID NO: 4728 - RNA, 19 nt, Artificial Sequence
  Description of Artificial Sequence: Synthetic oligonucleotide
gggcucacugccauggaga

SEQ ID NO: 4729 - RNA, 19 nt, Artificial Sequence
  Description of Artificial Sequence: Synthetic oligonucleotide
ggcucacugccauggagac

SEQ ID NO: 4730 - RNA, 19 nt, Artificial Sequence
  Description of Artificial Sequence: Synthetic oligonucleotide
gcucacugccauggagaca

SEQ ID NO: 4731 - RNA, 19 nt, Artificial Sequence
  Description of Artificial Sequence: Synthetic oligonucleotide
cucacugccauggagacac

SEQ ID NO: 4732 - RNA, 19 nt, Artificial Sequence
  Description of Artificial Sequence: Synthetic oligonucleotide
ucacugccauggagacacu

SEQ ID NO: 4733 - RNA, 19 nt, Artificial Sequence
  Description of Artificial Sequence: Synthetic oligonucleotide
cacugccauggagacacug

SEQ ID NO: 4734 - RNA, 19 nt, Artificial Sequence
  Description of Artificial Sequence: Synthetic oligonucleotide
acugccauggagacacugu

SEQ ID NO: 4735 - RNA, 19 nt, Artificial Sequence
  Description of Artificial Sequence: Synthetic oligonucleotide
cugccauggagacacuguc

SEQ ID NO: 4736 - RNA, 19 nt, Artificial Sequence
  Description of Artificial Sequence: Synthetic oligonucleotide
ugccauggagacacugucg

SEQ ID NO: 4737 - RNA, 19 nt, Artificial Sequence
  Description of Artificial Sequence: Synthetic oligonucleotide
gccauggagacacugucgg

SEQ ID NO: 4738 - RNA, 19 nt, Artificial Sequence
  Description of Artificial Sequence: Synthetic oligonucleotide
ccauggagacacugucgga

SEQ ID NO: 4739 - RNA, 19 nt, Artificial Sequence
  Description of Artificial Sequence: Synthetic oligonucleotide
cauggagacacugucggac

SEQ ID NO: 4740 - RNA, 19 nt, Artificial Sequence
  Description of Artificial Sequence: Synthetic oligonucleotide
auggagacacugucggaca

SEQ ID NO: 4741 - RNA, 19 nt, Artificial Sequence
  Description of Artificial Sequence: Synthetic oligonucleotide
uggagacacugucggacau

SEQ ID NO: 4742 - RNA, 19 nt, Artificial Sequence
  Description of Artificial Sequence: Synthetic oligonucleotide
ggagacacugucggacauu

SEQ ID NO: 4743 - RNA, 19 nt, Artificial Sequence
  Description of Artificial Sequence: Synthetic oligonucleotide
gagacacugucggacauuc

SEQ ID NO: 4744 - RNA, 19 nt, Artificial Sequence
  Description of Artificial Sequence: Synthetic oligonucleotide
agacacugucggacauucg

SEQ ID NO: 4745 - RNA, 19 nt, Artificial Sequence
  Description of Artificial Sequence: Synthetic oligonucleotide
gacacugucggacauucgg

SEQ ID NO: 4746 - RNA, 19 nt, Artificial Sequence
  Description of Artificial Sequence: Synthetic oligonucleotide
acacugucggacauucggg

SEQ ID NO: 4747 - RNA, 19 nt, Artificial Sequence
  Description of Artificial Sequence: Synthetic oligonucleotide
cacugucggacauucggga

SEQ ID NO: 4748 - RNA, 19 nt, Artificial Sequence
  Description of Artificial Sequence: Synthetic oligonucleotide
acugucggacauucgggaa

SEQ ID NO: 4749 - RNA, 19 nt, Artificial Sequence
  Description of Artificial Sequence: Synthetic oligonucleotide
cugucggacauucgggaag

SEQ ID NO: 4750 - RNA, 19 nt, Artificial Sequence
  Description of Artificial Sequence: Synthetic oligonucleotide
ugucggacauucgggaagg

SEQ ID NO: 4751 - RNA, 19 nt, Artificial Sequence
  Description of Artificial Sequence: Synthetic oligonucleotide
gucggacauucgggaaggu

SEQ ID NO: 4752 - RNA, 19 nt, Artificial Sequence
  Description of Artificial Sequence: Synthetic oligonucleotide
ucggacauucgggaaggug

SEQ ID NO: 4753 - RNA, 19 nt, Artificial Sequence
  Description of Artificial Sequence: Synthetic oligonucleotide
cggacauucgggaaggugc

SEQ ID NO: 4754 - RNA, 19 nt, Artificial Sequence
  Description of Artificial Sequence: Synthetic oligonucleotide
ggacauucgggaaggugcg

SEQ ID NO: 4755 - RNA, 19 nt, Artificial Sequence
  Description of Artificial Sequence: Synthetic oligonucleotide
gacauucgggaaggugcgc

SEQ ID NO: 4756 - RNA, 19 nt, Artificial Sequence
  Description of Artificial Sequence: Synthetic oligonucleotide
acauucgggaaggugcgcc

SEQ ID NO: 4757 - RNA, 19 nt, Artificial Sequence
  Description of Artificial Sequence: Synthetic oligonucleotide
cauucgggaaggugcgccg

SEQ ID NO: 4758 - RNA, 19 nt, Artificial Sequence
  Description of Artificial Sequence: Synthetic oligonucleotide
auucgggaaggugcgccgc

SEQ ID NO: 4759 - RNA, 19 nt, Artificial Sequence
  Description of Artificial Sequence: Synthetic oligonucleotide
uucgggaaggugcgccgcu

SEQ ID NO: 4760 - RNA, 19 nt, Artificial Sequence
  Description of Artificial Sequence: Synthetic oligonucleotide
ucgggaaggugcgccgcua

SEQ ID NO: 4761 - RNA, 19 nt, Artificial Sequence
  Description of Artificial Sequence: Synthetic oligonucleotide
cgggaaggugcgccgcuag

SEQ ID NO: 4762 - RNA, 19 nt, Artificial Sequence
  Description of Artificial Sequence: Synthetic oligonucleotide
gggaaggugcgccgcuagg

SEQ ID NO: 4763 - RNA, 19 nt, Artificial Sequence
  Description of Artificial Sequence: Synthetic oligonucleotide
ggaaggugcgccgcuaggg

SEQ ID NO: 4764 - RNA, 19 nt, Artificial Sequence
  Description of Artificial Sequence: Synthetic oligonucleotide
gaaggugcgccgcuagggg

SEQ ID NO: 4765 - RNA, 19 nt, Artificial Sequence
  Description of Artificial Sequence: Synthetic oligonucleotide
aaggugcgccgcuaggggu

SEQ ID NO: 4766 - RNA, 19 nt, Artificial Sequence
  Description of Artificial Sequence: Synthetic oligonucleotide
aggugcgccgcuagggguc

SEQ ID NO: 4767 - RNA, 19 nt, Artificial Sequence
  Description of Artificial Sequence: Synthetic oligonucleotide
ggugcgccgcuaggggucc

SEQ ID NO: 4768 - RNA, 19 nt, Artificial Sequence
  Description of Artificial Sequence: Synthetic oligonucleotide
gugcgccgcuaggggucca

SEQ ID NO: 4769 - RNA, 19 nt, Artificial Sequence
  Description of Artificial Sequence: Synthetic oligonucleotide
ugcgccgcuagggguccac

SEQ ID NO: 4770 - RNA, 19 nt, Artificial Sequence
  Description of Artificial Sequence: Synthetic oligonucleotide
gcgccgcuagggguccacc

SEQ ID NO: 4771 - RNA, 19 nt, Artificial Sequence
  Description of Artificial Sequence: Synthetic oligonucleotide
cgccgcuagggguccaccu

SEQ ID NO: 4772 - RNA, 19 nt, Artificial Sequence
  Description of Artificial Sequence: Synthetic oligonucleotide
gccgcuagggguccaccug

SEQ ID NO: 4773 - RNA, 19 nt, Artificial Sequence
  Description of Artificial Sequence: Synthetic oligonucleotide
ccgcuagggguccaccugc

SEQ ID NO: 4774 - RNA, 19 nt, Artificial Sequence
  Description of Artificial Sequence: Synthetic oligonucleotide
cgcuagggguccaccugcc

SEQ ID NO: 4775 - RNA, 19 nt, Artificial Sequence
  Description of Artificial Sequence: Synthetic oligonucleotide
gcuagggguccaccugccu

SEQ ID NO: 4776 - RNA, 19 nt, Artificial Sequence
  Description of Artificial Sequence: Synthetic oligonucleotide
cuagggguccaccugccuu

SEQ ID NO: 4777 - RNA, 19 nt, Artificial Sequence
  Description of Artificial Sequence: Synthetic oligonucleotide
uagggguccaccugccuuu

SEQ ID NO: 4778 - RNA, 19 nt, Artificial Sequence
  Description of Artificial Sequence: Synthetic oligonucleotide
agggguccaccugccuuuu

SEQ ID NO: 4779 - RNA, 19 nt, Artificial Sequence
  Description of Artificial Sequence: Synthetic oligonucleotide
gggguccaccugccuuuug

SEQ ID NO: 4780 - RNA, 19 nt, Artificial Sequence
  Description of Artificial Sequence: Synthetic oligonucleotide
ggguccaccugccuuuugu

SEQ ID NO: 4781 - RNA, 19 nt, Artificial Sequence
  Description of Artificial Sequence: Synthetic oligonucleotide
gguccaccugccuuuugug

SEQ ID NO: 4782 - RNA, 19 nt, Artificial Sequence
  Description of Artificial Sequence: Synthetic oligonucleotide
guccaccugccuuuugugg

SEQ ID NO: 4783 - RNA, 19 nt, Artificial Sequence
  Description of Artificial Sequence: Synthetic oligonucleotide
uccaccugccuuuuguggg

SEQ ID NO: 4784 - RNA, 19 nt, Artificial Sequence
  Description of Artificial Sequence: Synthetic oligonucleotide
ccaccugccuuuugugggc

SEQ ID NO: 4785 - RNA, 19 nt, Artificial Sequence
  Description of Artificial Sequence: Synthetic oligonucleotide
caccugccuuuugugggcu

SEQ ID NO: 4786 - RNA, 19 nt, Artificial Sequence
  Description of Artificial Sequence: Synthetic oligonucleotide
accugccuuuugugggcua

SEQ ID NO: 4787 - RNA, 19 nt, Artificial Sequence
  Description of Artificial Sequence: Synthetic oligonucleotide
ccugccuuuugugggcuac

SEQ ID NO: 4788 - RNA, 19 nt, Artificial Sequence
  Description of Artificial Sequence: Synthetic oligonucleotide
cugccuuuugugggcuacu

SEQ ID NO: 4789 - RNA, 19 nt, Artificial Sequence
  Description of Artificial Sequence: Synthetic oligonucleotide
ugccuuuugugggcuacuc

SEQ ID NO: 4790 - RNA, 19 nt, Artificial Sequence
  Description of Artificial Sequence: Synthetic oligonucleotide
gccuuuugugggcuacucc

SEQ ID NO: 4791 - RNA, 19 nt, Artificial Sequence
  Description of Artificial Sequence: Synthetic oligonucleotide
ccuuuugugggcuacuccu

SEQ ID NO: 4792 - RNA, 19 nt, Artificial Sequence
  Description of Artificial Sequence: Synthetic oligonucleotide
cuuuugugggcuacuccua

SEQ ID NO: 4793 - RNA, 19 nt, Artificial Sequence
  Description of Artificial Sequence: Synthetic oligonucleotide
uuuugugggcuacuccuac

SEQ ID NO: 4794 - RNA, 19 nt, Artificial Sequence
  Description of Artificial Sequence: Synthetic oligonucleotide
uuugugggcuacuccuacu

SEQ ID NO: 4795 - RNA, 19 nt, Artificial Sequence
  Description of Artificial Sequence: Synthetic oligonucleotide
uugugggcuacuccuacuc

SEQ ID NO: 4796 - RNA, 19 nt, Artificial Sequence
  Description of Artificial Sequence: Synthetic oligonucleotide
ugugggcuacuccuacucc

SEQ ID NO: 4797 - RNA, 19 nt, Artificial Sequence
  Description of Artificial Sequence: Synthetic oligonucleotide
gugggcuacuccuacuccu

SEQ ID NO: 4798 - RNA, 19 nt, Artificial Sequence
  Description of Artificial Sequence: Synthetic oligonucleotide
ugggcuacuccuacuccug

SEQ ID NO: 4799 - RNA, 19 nt, Artificial Sequence
  Description of Artificial Sequence: Synthetic oligonucleotide
gggcuacuccuacuccugc

SEQ ID NO: 4800 - RNA, 19 nt, Artificial Sequence
  Description of Artificial Sequence: Synthetic oligonucleotide
ggcuacuccuacuccugca

SEQ ID NO: 4801 - RNA, 19 nt, Artificial Sequence
  Description of Artificial Sequence: Synthetic oligonucleotide
gcuacuccuacuccugcau

SEQ ID NO: 4802 - RNA, 19 nt, Artificial Sequence
  Description of Artificial Sequence: Synthetic oligonucleotide
cuacuccuacuccugcaug

SEQ ID NO: 4803 - RNA, 19 nt, Artificial Sequence
  Description of Artificial Sequence: Synthetic oligonucleotide
uacuccuacuccugcaugg

SEQ ID NO: 4804 - RNA, 19 nt, Artificial Sequence
  Description of Artificial Sequence: Synthetic oligonucleotide
acuccuacuccugcauggc

SEQ ID NO: 4805 - RNA, 19 nt, Artificial Sequence
  Description of Artificial Sequence: Synthetic oligonucleotide
cuccuacuccugcauggcc

SEQ ID NO: 4806 - RNA, 19 nt, Artificial Sequence
  Description of Artificial Sequence: Synthetic oligonucleotide
uccuacuccugcauggccc

SEQ ID NO: 4807 - RNA, 19 nt, Artificial Sequence
  Description of Artificial Sequence: Synthetic oligonucleotide
ccuacuccugcauggcccu

SEQ ID NO: 4808 - RNA, 19 nt, Artificial Sequence
  Description of Artificial Sequence: Synthetic oligonucleotide
cuacuccugcauggcccuc

SEQ ID NO: 4809 - RNA, 19 nt, Artificial Sequence
  Description of Artificial Sequence: Synthetic oligonucleotide
uacuccugcauggcccuca

SEQ ID NO: 4810 - RNA, 19 nt, Artificial Sequence
  Description of Artificial Sequence: Synthetic oligonucleotide
acuccugcauggcccucag

SEQ ID NO: 4811 - RNA, 19 nt, Artificial Sequence
  Description of Artificial Sequence: Synthetic oligonucleotide
cuccugcauggcccucagg

SEQ ID NO: 4812 - RNA, 19 nt, Artificial Sequence
  Description of Artificial Sequence: Synthetic oligonucleotide
uccugcauggcccucaggg

SEQ ID NO: 4813 - RNA, 19 nt, Artificial Sequence
  Description of Artificial Sequence: Synthetic oligonucleotide
ccugcauggcccucaggga

SEQ ID NO: 4814 - RNA, 19 nt, Artificial Sequence
  Description of Artificial Sequence: Synthetic oligonucleotide
cugcauggcccucagggac

SEQ ID NO: 4815 - RNA, 19 nt, Artificial Sequence
  Description of Artificial Sequence: Synthetic oligonucleotide
ugcauggcccucagggaca

SEQ ID NO: 4816 - RNA, 19 nt, Artificial Sequence
  Description of Artificial Sequence: Synthetic oligonucleotide
gcauggcccucagggacag

SEQ ID NO: 4817 - RNA, 19 nt, Artificial Sequence
  Description of Artificial Sequence: Synthetic oligonucleotide
cauggcccucagggacagu

SEQ ID NO: 4818 - RNA, 19 nt, Artificial Sequence
  Description of Artificial Sequence: Synthetic oligonucleotide
auggcccucagggacagug

SEQ ID NO: 4819 - RNA, 19 nt, Artificial Sequence
  Description of Artificial Sequence: Synthetic oligonucleotide
uggcccucagggacaguga

SEQ ID NO: 4820 - RNA, 19 nt, Artificial Sequence
  Description of Artificial Sequence: Synthetic oligonucleotide
ggcccucagggacagugag

SEQ ID NO: 4821 - RNA, 19 nt, Artificial Sequence
  Description of Artificial Sequence: Synthetic oligonucleotide
gcccucagggacagugagg

SEQ ID NO: 4822 - RNA, 19 nt, Artificial Sequence
  Description of Artificial Sequence: Synthetic oligonucleotide
cccucagggacagugaggu

SEQ ID NO: 4823 - RNA, 19 nt, Artificial Sequence
  Description of Artificial Sequence: Synthetic oligonucleotide
ccucagggacagugagguc

SEQ ID NO: 4824 - RNA, 19 nt, Artificial Sequence
  Description of Artificial Sequence: Synthetic oligonucleotide
cucagggacagugaggucc

SEQ ID NO: 4825 - RNA, 19 nt, Artificial Sequence
  Description of Artificial Sequence: Synthetic oligonucleotide
ucagggacagugagguccc

SEQ ID NO: 4826 - RNA, 19 nt, Artificial Sequence
  Description of Artificial Sequence: Synthetic oligonucleotide
cagggacagugagguccca

SEQ ID NO: 4827 - RNA, 19 nt, Artificial Sequence
  Description of Artificial Sequence: Synthetic oligonucleotide
agggacagugaggucccag

SEQ ID NO: 4828 - RNA, 19 nt, Artificial Sequence
  Description of Artificial Sequence: Synthetic oligonucleotide
gggacagugaggucccagg

SEQ ID NO: 4829 - RNA, 19 nt, Artificial Sequence
  Description of Artificial Sequence: Synthetic oligonucleotide
ggacagugaggucccaggc

SEQ ID NO: 4830 - RNA, 19 nt, Artificial Sequence
  Description of Artificial Sequence: Synthetic oligonucleotide
gacagugaggucccaggcc

SEQ ID NO: 4831 - RNA, 19 nt, Artificial Sequence
  Description of Artificial Sequence: Synthetic oligonucleotide
acagugaggucccaggccc

SEQ ID NO: 4832 - RNA, 19 nt, Artificial Sequence
  Description of Artificial Sequence: Synthetic oligonucleotide
cagugaggucccaggcccc

SEQ ID NO: 4833 - RNA, 19 nt, Artificial Sequence
  Description of Artificial Sequence: Synthetic oligonucleotide
agugaggucccaggcccca

SEQ ID NO: 4834 - RNA, 19 nt, Artificial Sequence
  Description of Artificial Sequence: Synthetic oligonucleotide
gugaggucccaggccccac

SEQ ID NO: 4835 - RNA, 19 nt, Artificial Sequence
  Description of Artificial Sequence: Synthetic oligonucleotide
ugaggucccaggccccaca

SEQ ID NO: 4836 - RNA, 19 nt, Artificial Sequence
  Description of Artificial Sequence: Synthetic oligonucleotide
gaggucccaggccccacac

SEQ ID NO: 4837 - RNA, 19 nt, Artificial Sequence
  Description of Artificial Sequence: Synthetic oligonucleotide
aggucccaggccccacacc

SEQ ID NO: 4838 - RNA, 19 nt, Artificial Sequence
  Description of Artificial Sequence: Synthetic oligonucleotide
ggucccaggccccacaccc

SEQ ID NO: 4839 - RNA, 19 nt, Artificial Sequence
  Description of Artificial Sequence: Synthetic oligonucleotide
gucccaggccccacaccca

SEQ ID NO: 4840 - RNA, 19 nt, Artificial Sequence
  Description of Artificial Sequence: Synthetic oligonucleotide
ucccaggccccacacccau

SEQ ID NO: 4841 - RNA, 19 nt, Artificial Sequence
  Description of Artificial Sequence: Synthetic oligonucleotide
cccaggccccacacccaug

SEQ ID NO: 4842 - RNA, 19 nt, Artificial Sequence
  Description of Artificial Sequence: Synthetic oligonucleotide
ccaggccccacacccaugg

SEQ ID NO: 4843 - RNA, 19 nt, Artificial Sequence
  Description of Artificial Sequence: Synthetic oligonucleotide
caggccccacacccaugga

SEQ ID NO: 4844 - RNA, 19 nt, Artificial Sequence
  Description of Artificial Sequence: Synthetic oligonucleotide
aggccccacacccauggaa

SEQ ID NO: 4845 - RNA, 19 nt, Artificial Sequence
  Description of Artificial Sequence: Synthetic oligonucleotide
ggccccacacccauggaac

SEQ ID NO: 4846 - RNA, 19 nt, Artificial Sequence
  Description of Artificial Sequence: Synthetic oligonucleotide
gccccacacccauggaacu

SEQ ID NO: 4847 - RNA, 19 nt, Artificial Sequence
  Description of Artificial Sequence: Synthetic oligonucleotide
ccccacacccauggaacug

SEQ ID NO: 4848 - RNA, 19 nt, Artificial Sequence
  Description of Artificial Sequence: Synthetic oligonucleotide
cccacacccauggaacugg

SEQ ID NO: 4849 - RNA, 19 nt, Artificial Sequence
  Description of Artificial Sequence: Synthetic oligonucleotide
ccacacccauggaacugga

SEQ ID NO: 4850 - RNA, 19 nt, Artificial Sequence
  Description of Artificial Sequence: Synthetic oligonucleotide
cacacccauggaacuggag

SEQ ID NO: 4851 - RNA, 19 nt, Artificial Sequence
  Description of Artificial Sequence: Synthetic oligonucleotide
acacccauggaacuggagg

SEQ ID NO: 4852 - RNA, 19 nt, Artificial Sequence
  Description of Artificial Sequence: Synthetic oligonucleotide
cacccauggaacuggaggc

SEQ ID NO: 4853 - RNA, 19 nt, Artificial Sequence
  Description of Artificial Sequence: Synthetic oligonucleotide
acccauggaacuggaggcc

SEQ ID NO: 4854 - RNA, 19 nt, Artificial Sequence
  Description of Artificial Sequence: Synthetic oligonucleotide
cccauggaacuggaggccg

SEQ ID NO: 4855 - RNA, 19 nt, Artificial Sequence
  Description of Artificial Sequence: Synthetic oligonucleotide
ccauggaacuggaggccga

SEQ ID NO: 4856 - RNA, 19 nt, Artificial Sequence
  Description of Artificial Sequence: Synthetic oligonucleotide
cauggaacuggaggccgag

SEQ ID NO: 4857 - RNA, 19 nt, Artificial Sequence
  Description of Artificial Sequence: Synthetic oligonucleotide
auggaacuggaggccgagc

SEQ ID NO: 4858 - RNA, 19 nt, Artificial Sequence
  Description of Artificial Sequence: Synthetic oligonucleotide
uggaacuggaggccgagca

SEQ ID NO: 4859 - RNA, 19 nt, Artificial Sequence
  Description of Artificial Sequence: Synthetic oligonucleotide
ggaacuggaggccgagcag

SEQ ID NO: 4860 - RNA, 19 nt, Artificial Sequence
  Description of Artificial Sequence: Synthetic oligonucleotide
gaacuggaggccgagcagc

SEQ ID NO: 4861 - RNA, 19 nt, Artificial Sequence
  Description of Artificial Sequence: Synthetic oligonucleotide
aacuggaggccgagcagcu

SEQ ID NO: 4862 - RNA, 19 nt, Artificial Sequence
  Description of Artificial Sequence: Synthetic oligonucleotide
acuggaggccgagcagcug

SEQ ID NO: 4863 - RNA, 19 nt, Artificial Sequence
  Description of Artificial Sequence: Synthetic oligonucleotide
cuggaggccgagcagcugc

SEQ ID NO: 4864 - RNA, 19 nt, Artificial Sequence
  Description of Artificial Sequence: Synthetic oligonucleotide
uggaggccgagcagcugcu

SEQ ID NO: 4865 - RNA, 19 nt, Artificial Sequence
  Description of Artificial Sequence: Synthetic oligonucleotide
ggaggccgagcagcugcuu

SEQ ID NO: 4866 - RNA, 19 nt, Artificial Sequence
  Description of Artificial Sequence: Synthetic oligonucleotide
gaggccgagcagcugcuug

SEQ ID NO: 4867 - RNA, 19 nt, Artificial Sequence
  Description of Artificial Sequence: Synthetic oligonucleotide
aggccgagcagcugcuuga

SEQ ID NO: 4868 - RNA, 19 nt, Artificial Sequence
  Description of Artificial Sequence: Synthetic oligonucleotide
ggccgagcagcugcuugag

SEQ ID NO: 4869 - RNA, 19 nt, Artificial Sequence
  Description of Artificial Sequence: Synthetic oligonucleotide
gccgagcagcugcuugagc

SEQ ID NO: 4870 - RNA, 19 nt, Artificial Sequence
  Description of Artificial Sequence: Synthetic oligonucleotide
ccgagcagcugcuugagcc

SEQ ID NO: 4871 - RNA, 19 nt, Artificial Sequence
  Description of Artificial Sequence: Synthetic oligonucleotide
cgagcagcugcuugagcca

SEQ ID NO: 4872 - RNA, 19 nt, Artificial Sequence
  Description of Artificial Sequence: Synthetic oligonucleotide
gagcagcugcuugagccac

SEQ ID NO: 4873 - RNA, 19 nt, Artificial Sequence
  Description of Artificial Sequence: Synthetic oligonucleotide
agcagcugcuugagccaca

SEQ ID NO: 4874 - RNA, 19 nt, Artificial Sequence
  Description of Artificial Sequence: Synthetic oligonucleotide
gcagcugcuugagccacac

SEQ ID NO: 4875 - RNA, 19 nt, Artificial Sequence
  Description of Artificial Sequence: Synthetic oligonucleotide
cagcugcuugagccacacg

SEQ ID NO: 4876 - RNA, 19 nt, Artificial Sequence
  Description of Artificial Sequence: Synthetic oligonucleotide
agcugcuugagccacacgu

SEQ ID NO: 4877 - RNA, 19 nt, Artificial Sequence
  Description of Artificial Sequence: Synthetic oligonucleotide
gcugcuugagccacacgug

SEQ ID NO: 4878 - RNA, 19 nt, Artificial Sequence
  Description of Artificial Sequence: Synthetic oligonucleotide
cugcuugagccacacgugc

SEQ ID NO: 4879 - RNA, 19 nt, Artificial Sequence
  Description of Artificial Sequence: Synthetic oligonucleotide
ugcuugagccacacgugca

SEQ ID NO: 4880 - RNA, 19 nt, Artificial Sequence
  Description of Artificial Sequence: Synthetic oligonucleotide
gcuugagccacacgugcaa

SEQ ID NO: 4881 - RNA, 19 nt, Artificial Sequence
  Description of Artificial Sequence: Synthetic oligonucleotide
cuugagccacacgugcaag

SEQ ID NO: 4882 - RNA, 19 nt, Artificial Sequence
  Description of Artificial Sequence: Synthetic oligonucleotide
uugagccacacgugcaagc

SEQ ID NO: 4883 - RNA, 19 nt, Artificial Sequence
  Description of Artificial Sequence: Synthetic oligonucleotide
ugagccacacgugcaagcg

SEQ ID NO: 4884 - RNA, 19 nt, Artificial Sequence
  Description of Artificial Sequence: Synthetic oligonucleotide
gagccacacgugcaagcgc

SEQ ID NO: 4885 - RNA, 19 nt, Artificial Sequence
  Description of Artificial Sequence: Synthetic oligonucleotide
agccacacgugcaagcgcc

SEQ ID NO: 4886 - RNA, 19 nt, Artificial Sequence
  Description of Artificial Sequence: Synthetic oligonucleotide
gccacacgugcaagcgccc

SEQ ID NO: 4887 - RNA, 19 nt, Artificial Sequence
  Description of Artificial Sequence: Synthetic oligonucleotide
ccacacgugcaagcgccca

SEQ ID NO: 4888 - RNA, 19 nt, Artificial Sequence
  Description of Artificial Sequence: Synthetic oligonucleotide
cacacgugcaagcgcccag

SEQ ID NO: 4889 - RNA, 19 nt, Artificial Sequence
  Description of Artificial Sequence: Synthetic oligonucleotide
acacgugcaagcgcccagc

SEQ ID NO: 4890 - RNA, 19 nt, Artificial Sequence
  Description of Artificial Sequence: Synthetic oligonucleotide
cacgugcaagcgcccagcc

SEQ ID NO: 4891 - RNA, 19 nt, Artificial Sequence
  Description of Artificial Sequence: Synthetic oligonucleotide
acgugcaagcgcccagccu

SEQ ID NO: 4892 - RNA, 19 nt, Artificial Sequence
  Description of Artificial Sequence: Synthetic oligonucleotide
cgugcaagcgcccagccug

SEQ ID NO: 4893 - RNA, 19 nt, Artificial Sequence
  Description of Artificial Sequence: Synthetic oligonucleotide
gugcaagcgcccagccugg

SEQ ID NO: 4894 - RNA, 19 nt, Artificial Sequence
  Description of Artificial Sequence: Synthetic oligonucleotide
ugcaagcgcccagccugga

SEQ ID NO: 4895 - RNA, 19 nt, Artificial Sequence
  Description of Artificial Sequence: Synthetic oligonucleotide
gcaagcgcccagccuggag

SEQ ID NO: 4896 - RNA, 19 nt, Artificial Sequence
  Description of Artificial Sequence: Synthetic oligonucleotide
caagcgcccagccuggagc

SEQ ID NO: 4897 - RNA, 19 nt, Artificial Sequence
  Description of Artificial Sequence: Synthetic oligonucleotide
aagcgcccagccuggagcc

SEQ ID NO: 4898 - RNA, 19 nt, Artificial Sequence
  Description of Artificial Sequence: Synthetic oligonucleotide
agcgcccagccuggagccc

SEQ ID NO: 4899 - RNA, 19 nt, Artificial Sequence
  Description of Artificial Sequence: Synthetic oligonucleotide
gcgcccagccuggagcccu

SEQ ID NO: 4900 - RNA, 19 nt, Artificial Sequence
  Description of Artificial Sequence: Synthetic oligonucleotide
cgcccagccuggagcccuc

SEQ ID NO: 4901 - RNA, 19 nt, Artificial Sequence
  Description of Artificial Sequence: Synthetic oligonucleotide
gcccagccuggagcccucg

SEQ ID NO: 4902 - RNA, 19 nt, Artificial Sequence
  Description of Artificial Sequence: Synthetic oligonucleotide
cccagccuggagcccucgg

SEQ ID NO: 4903 - RNA, 19 nt, Artificial Sequence
  Description of Artificial Sequence: Synthetic oligonucleotide
ccagccuggagcccucggu

SEQ ID NO: 4904 - RNA, 19 nt, Artificial Sequence
  Description of Artificial Sequence: Synthetic oligonucleotide
cagccuggagcccucggug

SEQ ID NO: 4905 - RNA, 19 nt, Artificial Sequence
  Description of Artificial Sequence: Synthetic oligonucleotide
agccuggagcccucggugu

SEQ ID NO: 4906 - RNA, 19 nt, Artificial Sequence
  Description of Artificial Sequence: Synthetic oligonucleotide
gccuggagcccucgguguc

SEQ ID NO: 4907 - RNA, 19 nt, Artificial Sequence
  Description of Artificial Sequence: Synthetic oligonucleotide
ccuggagcccucggugucc

SEQ ID NO: 4908 - RNA, 19 nt, Artificial Sequence
  Description of Artificial Sequence: Synthetic oligonucleotide
cuggagcccucgguguccc

SEQ ID NO: 4909 - RNA, 19 nt, Artificial Sequence
  Description of Artificial Sequence: Synthetic oligonucleotide
uggagcccucggugucccc

SEQ ID NO: 4910 - RNA, 19 nt, Artificial Sequence
  Description of Artificial Sequence: Synthetic oligonucleotide
ggagcccucggugucccca

SEQ ID NO: 4911 - RNA, 19 nt, Artificial Sequence
  Description of Artificial Sequence: Synthetic oligonucleotide
gagcccucgguguccccac

SEQ ID NO: 4912 - RNA, 19 nt, Artificial Sequence
  Description of Artificial Sequence: Synthetic oligonucleotide
agcccucgguguccccaca

SEQ ID NO: 4913 - RNA, 19 nt, Artificial Sequence
  Description of Artificial Sequence: Synthetic oligonucleotide
gcccucgguguccccacag

SEQ ID NO: 4914 - RNA, 19 nt, Artificial Sequence
  Description of Artificial Sequence: Synthetic oligonucleotide
cccucgguguccccacagg

SEQ ID NO: 4915 - RNA, 19 nt, Artificial Sequence
  Description of Artificial Sequence: Synthetic oligonucleotide
ccucgguguccccacagga

SEQ ID NO: 4916 - RNA, 19 nt, Artificial Sequence
  Description of Artificial Sequence: Synthetic oligonucleotide
cucgguguccccacaggau

SEQ ID NO: 4917 - RNA, 19 nt, Artificial Sequence
  Description of Artificial Sequence: Synthetic oligonucleotide
ucgguguccccacaggaug

SEQ ID NO: 4918 - RNA, 19 nt, Artificial Sequence
  Description of Artificial Sequence: Synthetic oligonucleotide
cgguguccccacaggauga

SEQ ID NO: 4919 - RNA, 19 nt, Artificial Sequence
  Description of Artificial Sequence: Synthetic oligonucleotide
gguguccccacaggaugaa

SEQ ID NO: 4920 - RNA, 19 nt, Artificial Sequence
  Description of Artificial Sequence: Synthetic oligonucleotide
guguccccacaggaugaaa

SEQ ID NO: 4921 - RNA, 19 nt, Artificial Sequence
  Description of Artificial Sequence: Synthetic oligonucleotide
uguccccacaggaugaaac

SEQ ID NO: 4922 - RNA, 19 nt, Artificial Sequence
  Description of Artificial Sequence: Synthetic oligonucleotide
guccccacaggaugaaaca

SEQ ID NO: 4923 - RNA, 19 nt, Artificial Sequence
  Description of Artificial Sequence: Synthetic oligonucleotide
uccccacaggaugaaacag

SEQ ID NO: 4924 - RNA, 19 nt, Artificial Sequence
  Description of Artificial Sequence: Synthetic oligonucleotide
ccccacaggaugaaacagc

SEQ ID NO: 4925 - RNA, 19 nt, Artificial Sequence
  Description of Artificial Sequence: Synthetic oligonucleotide
cccacaggaugaaacagcu

SEQ ID NO: 4926 - RNA, 19 nt, Artificial Sequence
  Description of Artificial Sequence: Synthetic oligonucleotide
ccacaggaugaaacagcug

SEQ ID NO: 4927 - RNA, 19 nt, Artificial Sequence
  Description of Artificial Sequence: Synthetic oligonucleotide
cacaggaugaaacagcuga

SEQ ID NO: 4928 - RNA, 19 nt, Artificial Sequence
  Description of Artificial Sequence: Synthetic oligonucleotide
acaggaugaaacagcugaa

SEQ ID NO: 4929 - RNA, 19 nt, Artificial Sequence
  Description of Artificial Sequence: Synthetic oligonucleotide
caggaugaaacagcugaag

SEQ ID NO: 4930 - RNA, 19 nt, Artificial Sequence
  Description of Artificial Sequence: Synthetic oligonucleotide
aggaugaaacagcugaagu

SEQ ID NO: 4931 - RNA, 19 nt, Artificial Sequence
  Description of Artificial Sequence: Synthetic oligonucleotide
ggaugaaacagcugaagug

SEQ ID NO: 4932 - RNA, 19 nt, Artificial Sequence
  Description of Artificial Sequence: Synthetic oligonucleotide
gaugaaacagcugaagugg

SEQ ID NO: 4933 - RNA, 19 nt, Artificial Sequence
  Description of Artificial Sequence: Synthetic oligonucleotide
augaaacagcugaaguggc

SEQ ID NO: 4934 - RNA, 19 nt, Artificial Sequence
  Description of Artificial Sequence: Synthetic oligonucleotide
ugaaacagcugaaguggca

SEQ ID NO: 4935 - RNA, 19 nt, Artificial Sequence
  Description of Artificial Sequence: Synthetic oligonucleotide
gaaacagcugaaguggcag

SEQ ID NO: 4936 - RNA, 19 nt, Artificial Sequence
  Description of Artificial Sequence: Synthetic oligonucleotide
aaacagcugaaguggcagu

SEQ ID NO: 4937 - RNA, 19 nt, Artificial Sequence
  Description of Artificial Sequence: Synthetic oligonucleotide
aacagcugaaguggcaguu

SEQ ID NO: 4938 - RNA, 19 nt, Artificial Sequence
  Description of Artificial Sequence: Synthetic oligonucleotide
acagcugaaguggcaguuc

SEQ ID NO: 4939 - RNA, 19 nt, Artificial Sequence
  Description of Artificial Sequence: Synthetic oligonucleotide
cagcugaaguggcaguucc

SEQ ID NO: 4940 - RNA, 19 nt, Artificial Sequence
  Description of Artificial Sequence: Synthetic oligonucleotide
agcugaaguggcaguucca

SEQ ID NO: 4941 - RNA, 19 nt, Artificial Sequence
  Description of Artificial Sequence: Synthetic oligonucleotide
gcugaaguggcaguuccag

SEQ ID NO: 4942 - RNA, 19 nt, Artificial Sequence
  Description of Artificial Sequence: Synthetic oligonucleotide
cugaaguggcaguuccagc

SEQ ID NO: 4943 - RNA, 19 nt, Artificial Sequence
  Description of Artificial Sequence: Synthetic oligonucleotide
ugaaguggcaguuccagcg

SEQ ID NO: 4944 - RNA, 19 nt, Artificial Sequence
  Description of Artificial Sequence: Synthetic oligonucleotide
gaaguggcaguuccagcgg

SEQ ID NO: 4945 - RNA, 19 nt, Artificial Sequence
  Description of Artificial Sequence: Synthetic oligonucleotide
aaguggcaguuccagcggc

SEQ ID NO: 4946 - RNA, 19 nt, Artificial Sequence
  Description of Artificial Sequence: Synthetic oligonucleotide
aguggcaguuccagcggcu

SEQ ID NO: 4947 - RNA, 19 nt, Artificial Sequence
  Description of Artificial Sequence: Synthetic oligonucleotide
guggcaguuccagcggcug

SEQ ID NO: 4948 - RNA, 19 nt, Artificial Sequence
  Description of Artificial Sequence: Synthetic oligonucleotide
uggcaguuccagcggcugu

SEQ ID NO: 4949 - RNA, 19 nt, Artificial Sequence
  Description of Artificial Sequence: Synthetic oligonucleotide
ggcaguuccagcggcuguc

SEQ ID NO: 4950 - RNA, 19 nt, Artificial Sequence
  Description of Artificial Sequence: Synthetic oligonucleotide
gcaguuccagcggcugucc

SEQ ID NO: 4951 - RNA, 19 nt, Artificial Sequence
  Description of Artificial Sequence: Synthetic oligonucleotide
caguuccagcggcuguccc

SEQ ID NO: 4952 - RNA, 19 nt, Artificial Sequence
  Description of Artificial Sequence: Synthetic oligonucleotide
aguuccagcggcugucccu

SEQ ID NO: 4953 - RNA, 19 nt, Artificial Sequence
  Description of Artificial Sequence: Synthetic oligonucleotide
guuccagcggcugucccug

SEQ ID NO: 4954 - RNA, 19 nt, Artificial Sequence
  Description of Artificial Sequence: Synthetic oligonucleotide
uuccagcggcugucccugc

SEQ ID NO: 4955 - RNA, 19 nt, Artificial Sequence
  Description of Artificial Sequence: Synthetic oligonucleotide
uccagcggcugucccugcg

SEQ ID NO: 4956 - RNA, 19 nt, Artificial Sequence
  Description of Artificial Sequence: Synthetic oligonucleotide
ccagcggcugucccugcgg

SEQ ID NO: 4957 - RNA, 19 nt, Artificial Sequence
  Description of Artificial Sequence: Synthetic oligonucleotide
cagcggcugucccugcggc

SEQ ID NO: 4958 - RNA, 19 nt, Artificial Sequence
  Description of Artificial Sequence: Synthetic oligonucleotide
agcggcugucccugcggca

SEQ ID NO: 4959 - RNA, 19 nt, Artificial Sequence
  Description of Artificial Sequence: Synthetic oligonucleotide
gcggcugucccugcggcag

SEQ ID NO: 4960 - RNA, 19 nt, Artificial Sequence
  Description of Artificial Sequence: Synthetic oligonucleotide
cggcugucccugcggcaga

SEQ ID NO: 4961 - RNA, 19 nt, Artificial Sequence
  Description of Artificial Sequence: Synthetic oligonucleotide
ggcugucccugcggcagag

SEQ ID NO: 4962 - RNA, 19 nt, Artificial Sequence
  Description of Artificial Sequence: Synthetic oligonucleotide
gcugucccugcggcagagg

SEQ ID NO: 4963 - RNA, 19 nt, Artificial Sequence
  Description of Artificial Sequence: Synthetic oligonucleotide
cugucccugcggcagaggc

SEQ ID NO: 4964 - RNA, 19 nt, Artificial Sequence
  Description of Artificial Sequence: Synthetic oligonucleotide
ugucccugcggcagaggcu

SEQ ID NO: 4965 - RNA, 19 nt, Artificial Sequence
  Description of Artificial Sequence: Synthetic oligonucleotide
gucccugcggcagaggcug

SEQ ID NO: 4966 - RNA, 19 nt, Artificial Sequence
  Description of Artificial Sequence: Synthetic oligonucleotide
ucccugcggcagaggcuga

SEQ ID NO: 4967 - RNA, 19 nt, Artificial Sequence
  Description of Artificial Sequence: Synthetic oligonucleotide
cccugcggcagaggcugag

SEQ ID NO: 4968 - RNA, 19 nt, Artificial Sequence
  Description of Artificial Sequence: Synthetic oligonucleotide
ccugcggcagaggcugagg

SEQ ID NO: 4969 - RNA, 19 nt, Artificial Sequence
  Description of Artificial Sequence: Synthetic oligonucleotide
cugcggcagaggcugaggc

SEQ ID NO: 4970 - RNA, 19 nt, Artificial Sequence
  Description of Artificial Sequence: Synthetic oligonucleotide
ugcggcagaggcugaggcc

SEQ ID NO: 4971 - RNA, 19 nt, Artificial Sequence
  Description of Artificial Sequence: Synthetic oligonucleotide
gcggcagaggcugaggccg

SEQ ID NO: 4972 - RNA, 19 nt, Artificial Sequence
  Description of Artificial Sequence: Synthetic oligonucleotide
cggcagaggcugaggccga

SEQ ID NO: 4973 - RNA, 19 nt, Artificial Sequence
  Description of Artificial Sequence: Synthetic oligonucleotide
ggcagaggcugaggccgag

SEQ ID NO: 4974 - RNA, 19 nt, Artificial Sequence
  Description of Artificial Sequence: Synthetic oligonucleotide
gcagaggcugaggccgagg

SEQ ID NO: 4975 - RNA, 19 nt, Artificial Sequence
  Description of Artificial Sequence: Synthetic oligonucleotide
cagaggcugaggccgaggu

SEQ ID NO: 4976 - RNA, 19 nt, Artificial Sequence
  Description of Artificial Sequence: Synthetic oligonucleotide
agaggcugaggccgaggug

SEQ ID NO: 4977 - RNA, 19 nt, Artificial Sequence
  Description of Artificial Sequence: Synthetic oligonucleotide
gaggcugaggccgagguga

SEQ ID NO: 4978 - RNA, 19 nt, Artificial Sequence
  Description of Artificial Sequence: Synthetic oligonucleotide
aggcugaggccgaggugac

SEQ ID NO: 4979 - RNA, 19 nt, Artificial Sequence
  Description of Artificial Sequence: Synthetic oligonucleotide
ggcugaggccgaggugacg

SEQ ID NO: 4980 - RNA, 19 nt, Artificial Sequence
  Description of Artificial Sequence: Synthetic oligonucleotide
gcugaggccgaggugacgc

SEQ ID NO: 4981 - RNA, 19 nt, Artificial Sequence
  Description of Artificial Sequence: Synthetic oligonucleotide
cugaggccgaggugacgcu

SEQ ID NO: 4982 - RNA, 19 nt, Artificial Sequence
  Description of Artificial Sequence: Synthetic oligonucleotide
ugaggccgaggugacgcug

SEQ ID NO: 4983 - RNA, 19 nt, Artificial Sequence
  Description of Artificial Sequence: Synthetic oligonucleotide
gaggccgaggugacgcugc

SEQ ID NO: 4984 - RNA, 19 nt, Artificial Sequence
  Description of Artificial Sequence: Synthetic oligonucleotide
aggccgaggugacgcugcg

SEQ ID NO: 4985 - RNA, 19 nt, Artificial Sequence
  Description of Artificial Sequence: Synthetic oligonucleotide
ggccgaggugacgcugcgg

SEQ ID NO: 4986 - RNA, 19 nt, Artificial Sequence
  Description of Artificial Sequence: Synthetic oligonucleotide
gccgaggugacgcugcggg

SEQ ID NO: 4987 - RNA, 19 nt, Artificial Sequence
  Description of Artificial Sequence: Synthetic oligonucleotide
ccgaggugacgcugcggga

SEQ ID NO: 4988 - RNA, 19 nt, Artificial Sequence
  Description of Artificial Sequence: Synthetic oligonucleotide
cgaggugacgcugcgggag

SEQ ID NO: 4989 - RNA, 19 nt, Artificial Sequence
  Description of Artificial Sequence: Synthetic oligonucleotide
gaggugacgcugcgggagc

SEQ ID NO: 4990 - RNA, 19 nt, Artificial Sequence
  Description of Artificial Sequence: Synthetic oligonucleotide
aggugacgcugcgggagcu

SEQ ID NO: 4991 - RNA, 19 nt, Artificial Sequence
  Description of Artificial Sequence: Synthetic oligonucleotide
ggugacgcugcgggagcuc

SEQ ID NO: 4992 - RNA, 19 nt, Artificial Sequence
  Description of Artificial Sequence: Synthetic oligonucleotide
gugacgcugcgggagcucc

SEQ ID NO: 4993 - RNA, 19 nt, Artificial Sequence
  Description of Artificial Sequence: Synthetic oligonucleotide
ugacgcugcgggagcucca

SEQ ID NO: 4994 - RNA, 19 nt, Artificial Sequence
  Description of Artificial Sequence: Synthetic oligonucleotide
gacgcugcgggagcuccag

SEQ ID NO: 4995 - RNA, 19 nt, Artificial Sequence
  Description of Artificial Sequence: Synthetic oligonucleotide
acgcugcgggagcuccagg

SEQ ID NO: 4996 - RNA, 19 nt, Artificial Sequence
  Description of Artificial Sequence: Synthetic oligonucleotide
cgcugcgggagcuccagga

SEQ ID NO: 4997 - RNA, 19 nt, Artificial Sequence
  Description of Artificial Sequence: Synthetic oligonucleotide
gcugcgggagcuccaggaa

SEQ ID NO: 4998 - RNA, 19 nt, Artificial Sequence
  Description of Artificial Sequence: Synthetic oligonucleotide
cugcgggagcuccaggaag

SEQ ID NO: 4999 - RNA, 19 nt, Artificial Sequence
  Description of Artificial Sequence: Synthetic oligonucleotide
ugcgggagcuccaggaagc

SEQ ID NO: 5000 - RNA, 19 nt, Artificial Sequence
  Description of Artificial Sequence: Synthetic oligonucleotide
gcgggagcuccaggaagcc

SEQ ID NO: 5001 - RNA, 19 nt, Artificial Sequence
  Description of Artificial Sequence: Synthetic oligonucleotide
cgggagcuccaggaagccc

SEQ ID NO: 5002 - RNA, 19 nt, Artificial Sequence
  Description of Artificial Sequence: Synthetic oligonucleotide
gggagcuccaggaagcccu

SEQ ID NO: 5003 - RNA, 19 nt, Artificial Sequence
  Description of Artificial Sequence: Synthetic oligonucleotide
ggagcuccaggaagcccug

SEQ ID NO: 5004 - RNA, 19 nt, Artificial Sequence
  Description of Artificial Sequence: Synthetic oligonucleotide
gagcuccaggaagcccugg

SEQ ID NO: 5005 - RNA, 19 nt, Artificial Sequence
  Description of Artificial Sequence: Synthetic oligonucleotide
agcuccaggaagcccugga

SEQ ID NO: 5006 - RNA, 19 nt, Artificial Sequence
  Description of Artificial Sequence: Synthetic oligonucleotide
gcuccaggaagcccuggag

SEQ ID NO: 5007 - RNA, 19 nt, Artificial Sequence
  Description of Artificial Sequence: Synthetic oligonucleotide
cuccaggaagcccuggagg

SEQ ID NO: 5008 - RNA, 19 nt, Artificial Sequence
  Description of Artificial Sequence: Synthetic oligonucleotide
uccaggaagcccuggagga

SEQ ID NO: 5009 - RNA, 19 nt, Artificial Sequence
  Description of Artificial Sequence: Synthetic oligonucleotide
ccaggaagcccuggaggag

SEQ ID NO: 5010 - RNA, 19 nt, Artificial Sequence
  Description of Artificial Sequence: Synthetic oligonucleotide
caggaagcccuggaggagg

SEQ ID NO: 5011 - RNA, 19 nt, Artificial Sequence
  Description of Artificial Sequence: Synthetic oligonucleotide
aggaagcccuggaggagga

SEQ ID NO: 5012 - RNA, 19 nt, Artificial Sequence
  Description of Artificial Sequence: Synthetic oligonucleotide
ggaagcccuggaggaggag

SEQ ID NO: 5013 - RNA, 19 nt, Artificial Sequence
  Description of Artificial Sequence: Synthetic oligonucleotide
gaagcccuggaggaggagg

SEQ ID NO: 5014 - RNA, 19 nt, Artificial Sequence
  Description of Artificial Sequence: Synthetic oligonucleotide
aagcccuggaggaggaggu

SEQ ID NO: 5015 - RNA, 19 nt, Artificial Sequence
  Description of Artificial Sequence: Synthetic oligonucleotide
agcccuggaggaggaggug

SEQ ID NO: 5016 - RNA, 19 nt, Artificial Sequence
  Description of Artificial Sequence: Synthetic oligonucleotide
gcccuggaggaggaggugc

SEQ ID NO: 5017 - RNA, 19 nt, Artificial Sequence
  Description of Artificial Sequence: Synthetic oligonucleotide
cccuggaggaggaggugcu

SEQ ID NO: 5018 - RNA, 19 nt, Artificial Sequence
  Description of Artificial Sequence: Synthetic oligonucleotide
ccuggaggaggaggugcuc

SEQ ID NO: 5019 - RNA, 19 nt, Artificial Sequence
  Description of Artificial Sequence: Synthetic oligonucleotide
cuggaggaggaggugcuca

SEQ ID NO: 5020 - RNA, 19 nt, Artificial Sequence
  Description of Artificial Sequence: Synthetic oligonucleotide
uggaggaggaggugcucac

SEQ ID NO: 5021 - RNA, 19 nt, Artificial Sequence
  Description of Artificial Sequence: Synthetic oligonucleotide
ggaggaggaggugcucacc

SEQ ID NO: 5022 - RNA, 19 nt, Artificial Sequence
  Description of Artificial Sequence: Synthetic oligonucleotide
gaggaggaggugcucaccc

SEQ ID NO: 5023 - RNA, 19 nt, Artificial Sequence
  Description of Artificial Sequence: Synthetic oligonucleotide
aggaggaggugcucacccg

SEQ ID NO: 5024 - RNA, 19 nt, Artificial Sequence
  Description of Artificial Sequence: Synthetic oligonucleotide
ggaggaggugcucacccgg

SEQ ID NO: 5025 - RNA, 19 nt, Artificial Sequence
  Description of Artificial Sequence: Synthetic oligonucleotide
gaggaggugcucacccggc

SEQ ID NO: 5026 - RNA, 19 nt, Artificial Sequence
  Description of Artificial Sequence: Synthetic oligonucleotide
aggaggugcucacccggca

SEQ ID NO: 5027 - RNA, 19 nt, Artificial Sequence
  Description of Artificial Sequence: Synthetic oligonucleotide
ggaggugcucacccggcag

SEQ ID NO: 5028 - RNA, 19 nt, Artificial Sequence
  Description of Artificial Sequence: Synthetic oligonucleotide
gaggugcucacccggcaga

SEQ ID NO: 5029 - RNA, 19 nt, Artificial Sequence
  Description of Artificial Sequence: Synthetic oligonucleotide
aggugcucacccggcagag

SEQ ID NO: 5030 - RNA, 19 nt, Artificial Sequence
  Description of Artificial Sequence: Synthetic oligonucleotide
ggugcucacccggcagagc

SEQ ID NO: 5031 - RNA, 19 nt, Artificial Sequence
  Description of Artificial Sequence: Synthetic oligonucleotide
gugcucacccggcagagcc

SEQ ID NO: 5032 - RNA, 19 nt, Artificial Sequence
  Description of Artificial Sequence: Synthetic oligonucleotide
ugcucacccggcagagccu

SEQ ID NO: 5033 - RNA, 19 nt, Artificial Sequence
  Description of Artificial Sequence: Synthetic oligonucleotide
gcucacccggcagagccug

SEQ ID NO: 5034 - RNA, 19 nt, Artificial Sequence
  Description of Artificial Sequence: Synthetic oligonucleotide
cucacccggcagagccuga

SEQ ID NO: 5035 - RNA, 19 nt, Artificial Sequence
  Description of Artificial Sequence: Synthetic oligonucleotide
ucacccggcagagccugag

SEQ ID NO: 5036 - RNA, 19 nt, Artificial Sequence
  Description of Artificial Sequence: Synthetic oligonucleotide
cacccggcagagccugagc

SEQ ID NO: 5037 - RNA, 19 nt, Artificial Sequence
  Description of Artificial Sequence: Synthetic oligonucleotide
acccggcagagccugagcc

SEQ ID NO: 5038 - RNA, 19 nt, Artificial Sequence
  Description of Artificial Sequence: Synthetic oligonucleotide
cccggcagagccugagccg

SEQ ID NO: 5039 - RNA, 19 nt, Artificial Sequence
  Description of Artificial Sequence: Synthetic oligonucleotide
ccggcagagccugagccgg

SEQ ID NO: 5040 - RNA, 19 nt, Artificial Sequence
  Description of Artificial Sequence: Synthetic oligonucleotide
cggcagagccugagccggg

SEQ ID NO: 5041 - RNA, 19 nt, Artificial Sequence
  Description of Artificial Sequence: Synthetic oligonucleotide
ggcagagccugagccggga

SEQ ID NO: 5042 - RNA, 19 nt, Artificial Sequence
  Description of Artificial Sequence: Synthetic oligonucleotide
gcagagccugagccgggag

SEQ ID NO: 5043 - RNA, 19 nt, Artificial Sequence
  Description of Artificial Sequence: Synthetic oligonucleotide
cagagccugagccgggaga

SEQ ID NO: 5044 - RNA, 19 nt, Artificial Sequence
  Description of Artificial Sequence: Synthetic oligonucleotide
agagccugagccgggagau

SEQ ID NO: 5045 - RNA, 19 nt, Artificial Sequence
  Description of Artificial Sequence: Synthetic oligonucleotide
gagccugagccgggagaug

SEQ ID NO: 5046 - RNA, 19 nt, Artificial Sequence
  Description of Artificial Sequence: Synthetic oligonucleotide
agccugagccgggagaugg

SEQ ID NO: 5047 - RNA, 19 nt, Artificial Sequence
  Description of Artificial Sequence: Synthetic oligonucleotide
gccugagccgggagaugga

SEQ ID NO: 5048 - RNA, 19 nt, Artificial Sequence
  Description of Artificial Sequence: Synthetic oligonucleotide
ccugagccgggagauggag

SEQ ID NO: 5049 - RNA, 19 nt, Artificial Sequence
  Description of Artificial Sequence: Synthetic oligonucleotide
cugagccgggagauggagg

SEQ ID NO: 5050 - RNA, 19 nt, Artificial Sequence
  Description of Artificial Sequence: Synthetic oligonucleotide
ugagccgggagauggaggc

SEQ ID NO: 5051 - RNA, 19 nt, Artificial Sequence
  Description of Artificial Sequence: Synthetic oligonucleotide
gagccgggagauggaggcc

SEQ ID NO: 5052 - RNA, 19 nt, Artificial Sequence
  Description of Artificial Sequence: Synthetic oligonucleotide
agccgggagauggaggcca

SEQ ID NO: 5053 - RNA, 19 nt, Artificial Sequence
  Description of Artificial Sequence: Synthetic oligonucleotide
gccgggagauggaggccau

SEQ ID NO: 5054 - RNA, 19 nt, Artificial Sequence
  Description of Artificial Sequence: Synthetic oligonucleotide
ccgggagauggaggccauc

SEQ ID NO: 5055 - RNA, 19 nt, Artificial Sequence
  Description of Artificial Sequence: Synthetic oligonucleotide
cgggagauggaggccaucc

SEQ ID NO: 5056 - RNA, 19 nt, Artificial Sequence
  Description of Artificial Sequence: Synthetic oligonucleotide
gggagauggaggccauccg

SEQ ID NO: 5057 - RNA, 19 nt, Artificial Sequence
  Description of Artificial Sequence: Synthetic oligonucleotide
ggagauggaggccauccgc

SEQ ID NO: 5058 - RNA, 19 nt, Artificial Sequence
  Description of Artificial Sequence: Synthetic oligonucleotide
gagauggaggccauccgca

SEQ ID NO: 5059 - RNA, 19 nt, Artificial Sequence
  Description of Artificial Sequence: Synthetic oligonucleotide
agauggaggccauccgcac

SEQ ID NO: 5060 - RNA, 19 nt, Artificial Sequence
  Description of Artificial Sequence: Synthetic oligonucleotide
gauggaggccauccgcacg

SEQ ID NO: 5061 - RNA, 19 nt, Artificial Sequence
  Description of Artificial Sequence: Synthetic oligonucleotide
auggaggccauccgcacgg

SEQ ID NO: 5062 - RNA, 19 nt, Artificial Sequence
  Description of Artificial Sequence: Synthetic oligonucleotide
uggaggccauccgcacgga

SEQ ID NO: 5063 - RNA, 19 nt, Artificial Sequence
  Description of Artificial Sequence: Synthetic oligonucleotide
ggaggccauccgcacggac

SEQ ID NO: 5064 - RNA, 19 nt, Artificial Sequence
  Description of Artificial Sequence: Synthetic oligonucleotide
gaggccauccgcacggaca

SEQ ID NO: 5065 - RNA, 19 nt, Artificial Sequence
  Description of Artificial Sequence: Synthetic oligonucleotide
aggccauccgcacggacaa

SEQ ID NO: 5066 - RNA, 19 nt, Artificial Sequence
  Description of Artificial Sequence: Synthetic oligonucleotide
ggccauccgcacggacaac

SEQ ID NO: 5067 - RNA, 19 nt, Artificial Sequence
  Description of Artificial Sequence: Synthetic oligonucleotide
gccauccgcacggacaacc

SEQ ID NO: 5068 - RNA, 19 nt, Artificial Sequence
  Description of Artificial Sequence: Synthetic oligonucleotide
ccauccgcacggacaacca

SEQ ID NO: 5069 - RNA, 19 nt, Artificial Sequence
  Description of Artificial Sequence: Synthetic oligonucleotide
cauccgcacggacaaccag

SEQ ID NO: 5070 - RNA, 19 nt, Artificial Sequence
  Description of Artificial Sequence: Synthetic oligonucleotide
auccgcacggacaaccaga

SEQ ID NO: 5071 - RNA, 19 nt, Artificial Sequence
  Description of Artificial Sequence: Synthetic oligonucleotide
uccgcacggacaaccagaa

SEQ ID NO: 5072 - RNA, 19 nt, Artificial Sequence
  Description of Artificial Sequence: Synthetic oligonucleotide
ccgcacggacaaccagaac

SEQ ID NO: 5073 - RNA, 19 nt, Artificial Sequence
  Description of Artificial Sequence: Synthetic oligonucleotide
cgcacggacaaccagaacu

SEQ ID NO: 5074 - RNA, 19 nt, Artificial Sequence
  Description of Artificial Sequence: Synthetic oligonucleotide
gcacggacaaccagaacuu

SEQ ID NO: 5075 - RNA, 19 nt, Artificial Sequence
  Description of Artificial Sequence: Synthetic oligonucleotide
cacggacaaccagaacuuc

SEQ ID NO: 5076 - RNA, 19 nt, Artificial Sequence
  Description of Artificial Sequence: Synthetic oligonucleotide
acggacaaccagaacuucg

SEQ ID NO: 5077 - RNA, 19 nt, Artificial Sequence
  Description of Artificial Sequence: Synthetic oligonucleotide
cggacaaccagaacuucgc

SEQ ID NO: 5078 - RNA, 19 nt, Artificial Sequence
  Description of Artificial Sequence: Synthetic oligonucleotide
ggacaaccagaacuucgcc

SEQ ID NO: 5079 - RNA, 19 nt, Artificial Sequence
  Description of Artificial Sequence: Synthetic oligonucleotide
gacaaccagaacuucgcca

SEQ ID NO: 5080 - RNA, 19 nt, Artificial Sequence
  Description of Artificial Sequence: Synthetic oligonucleotide
acaaccagaacuucgccag

SEQ ID NO: 5081 - RNA, 19 nt, Artificial Sequence
  Description of Artificial Sequence: Synthetic oligonucleotide
caaccagaacuucgccagu

SEQ ID NO: 5082 - RNA, 19 nt, Artificial Sequence
  Description of Artificial Sequence: Synthetic oligonucleotide
aaccagaacuucgccaguc

SEQ ID NO: 5083 - RNA, 19 nt, Artificial Sequence
  Description of Artificial Sequence: Synthetic oligonucleotide
accagaacuucgccaguca

SEQ ID NO: 5084 - RNA, 19 nt, Artificial Sequence
  Description of Artificial Sequence: Synthetic oligonucleotide
ccagaacuucgccagucaa

SEQ ID NO: 5085 - RNA, 19 nt, Artificial Sequence
  Description of Artificial Sequence: Synthetic oligonucleotide
cagaacuucgccagucaac

SEQ ID NO: 5086 - RNA, 19 nt, Artificial Sequence
  Description of Artificial Sequence: Synthetic oligonucleotide
agaacuucgccagucaacu

SEQ ID NO: 5087 - RNA, 19 nt, Artificial Sequence
  Description of Artificial Sequence: Synthetic oligonucleotide
gaacuucgccagucaacua

SEQ ID NO: 5088 - RNA, 19 nt, Artificial Sequence
  Description of Artificial Sequence: Synthetic oligonucleotide
aacuucgccagucaacuac

SEQ ID NO: 5089 - RNA, 19 nt, Artificial Sequence
  Description of Artificial Sequence: Synthetic oligonucleotide
acuucgccagucaacuacg

SEQ ID NO: 5090 - RNA, 19 nt, Artificial Sequence
  Description of Artificial Sequence: Synthetic oligonucleotide
cuucgccagucaacuacgc

SEQ ID NO: 5091 - RNA, 19 nt, Artificial Sequence
  Description of Artificial Sequence: Synthetic oligonucleotide
uucgccagucaacuacgcg

SEQ ID NO: 5092 - RNA, 19 nt, Artificial Sequence
  Description of Artificial Sequence: Synthetic oligonucleotide
ucgccagucaacuacgcga

SEQ ID NO: 5093 - RNA, 19 nt, Artificial Sequence
  Description of Artificial Sequence: Synthetic oligonucleotide
cgccagucaacuacgcgag

SEQ ID NO: 5094 - RNA, 19 nt, Artificial Sequence
  Description of Artificial Sequence: Synthetic oligonucleotide
gccagucaacuacgcgagg

SEQ ID NO: 5095 - RNA, 19 nt, Artificial Sequence
  Description of Artificial Sequence: Synthetic oligonucleotide
ccagucaacuacgcgaggc

SEQ ID NO: 5096 - RNA, 19 nt, Artificial Sequence
  Description of Artificial Sequence: Synthetic oligonucleotide
cagucaacuacgcgaggca

SEQ ID NO: 5097 - RNA, 19 nt, Artificial Sequence
  Description of Artificial Sequence: Synthetic oligonucleotide
agucaacuacgcgaggcag

SEQ ID NO: 5098 - RNA, 19 nt, Artificial Sequence
  Description of Artificial Sequence: Synthetic oligonucleotide
gucaacuacgcgaggcaga

SEQ ID NO: 5099 - RNA, 19 nt, Artificial Sequence
  Description of Artificial Sequence: Synthetic oligonucleotide
ucaacuacgcgaggcagag

SEQ ID NO: 5100 - RNA, 19 nt, Artificial Sequence
  Description of Artificial Sequence: Synthetic oligonucleotide
caacuacgcgaggcagagg

SEQ ID NO: 5101 - RNA, 19 nt, Artificial Sequence
  Description of Artificial Sequence: Synthetic oligonucleotide
aacuacgcgaggcagaggc

SEQ ID NO: 5102 - RNA, 19 nt, Artificial Sequence
  Description of Artificial Sequence: Synthetic oligonucleotide
acuacgcgaggcagaggcu

SEQ ID NO: 5103 - RNA, 19 nt, Artificial Sequence
  Description of Artificial Sequence: Synthetic oligonucleotide
cuacgcgaggcagaggcuc

SEQ ID NO: 5104 - RNA, 19 nt, Artificial Sequence
  Description of Artificial Sequence: Synthetic oligonucleotide
uacgcgaggcagaggcucg

SEQ ID NO: 5105 - RNA, 19 nt, Artificial Sequence
  Description of Artificial Sequence: Synthetic oligonucleotide
acgcgaggcagaggcucgg

SEQ ID NO: 5106 - RNA, 19 nt, Artificial Sequence
  Description of Artificial Sequence: Synthetic oligonucleotide
cgcgaggcagaggcucgga

SEQ ID NO: 5107 - RNA, 19 nt, Artificial Sequence
  Description of Artificial Sequence: Synthetic oligonucleotide
gcgaggcagaggcucggaa

SEQ ID NO: 5108 - RNA, 19 nt, Artificial Sequence
  Description of Artificial Sequence: Synthetic oligonucleotide
cgaggcagaggcucggaac

SEQ ID NO: 5109 - RNA, 19 nt, Artificial Sequence
  Description of Artificial Sequence: Synthetic oligonucleotide
gaggcagaggcucggaacc

SEQ ID NO: 5110 - RNA, 19 nt, Artificial Sequence
  Description of Artificial Sequence: Synthetic oligonucleotide
aggcagaggcucggaaccg

SEQ ID NO: 5111 - RNA, 19 nt, Artificial Sequence
  Description of Artificial Sequence: Synthetic oligonucleotide
ggcagaggcucggaaccgg

SEQ ID NO: 5112 - RNA, 19 nt, Artificial Sequence
  Description of Artificial Sequence: Synthetic oligonucleotide
gcagaggcucggaaccggg

SEQ ID NO: 5113 - RNA, 19 nt, Artificial Sequence
  Description of Artificial Sequence: Synthetic oligonucleotide
cagaggcucggaaccggga

SEQ ID NO: 5114 - RNA, 19 nt, Artificial Sequence
  Description of Artificial Sequence: Synthetic oligonucleotide
agaggcucggaaccgggac

SEQ ID NO: 5115 - RNA, 19 nt, Artificial Sequence
  Description of Artificial Sequence: Synthetic oligonucleotide
gaggcucggaaccgggacc

SEQ ID NO: 5116 - RNA, 19 nt, Artificial Sequence
  Description of Artificial Sequence: Synthetic oligonucleotide
aggcucggaaccgggaccu

SEQ ID NO: 5117 - RNA, 19 nt, Artificial Sequence
  Description of Artificial Sequence: Synthetic oligonucleotide
ggcucggaaccgggaccua

SEQ ID NO: 5118 - RNA, 19 nt, Artificial Sequence
  Description of Artificial Sequence: Synthetic oligonucleotide
gcucggaaccgggaccuag

SEQ ID NO: 5119 - RNA, 19 nt, Artificial Sequence
  Description of Artificial Sequence: Synthetic oligonucleotide
cucggaaccgggaccuaga

SEQ ID NO: 5120 - RNA, 19 nt, Artificial Sequence
  Description of Artificial Sequence: Synthetic oligonucleotide
ucggaaccgggaccuagag

SEQ ID NO: 5121 - RNA, 19 nt, Artificial Sequence
  Description of Artificial Sequence: Synthetic oligonucleotide
cggaaccgggaccuagagg

SEQ ID NO: 5122 - RNA, 19 nt, Artificial Sequence
  Description of Artificial Sequence: Synthetic oligonucleotide
ggaaccgggaccuagaggc

SEQ ID NO: 5123 - RNA, 19 nt, Artificial Sequence
  Description of Artificial Sequence: Synthetic oligonucleotide
gaaccgggaccuagaggca

SEQ ID NO: 5124 - RNA, 19 nt, Artificial Sequence
  Description of Artificial Sequence: Synthetic oligonucleotide
aaccgggaccuagaggcac

SEQ ID NO: 5125 - RNA, 19 nt, Artificial Sequence
  Description of Artificial Sequence: Synthetic oligonucleotide
accgggaccuagaggcaca

SEQ ID NO: 5126 - RNA, 19 nt, Artificial Sequence
  Description of Artificial Sequence: Synthetic oligonucleotide
ccgggaccuagaggcacac

SEQ ID NO: 5127 - RNA, 19 nt, Artificial Sequence
  Description of Artificial Sequence: Synthetic oligonucleotide
cgggaccuagaggcacacg

SEQ ID NO: 5128 - RNA, 19 nt, Artificial Sequence
  Description of Artificial Sequence: Synthetic oligonucleotide
gggaccuagaggcacacgu

SEQ ID NO: 5129 - RNA, 19 nt, Artificial Sequence
  Description of Artificial Sequence: Synthetic oligonucleotide
ggaccuagaggcacacguc

SEQ ID NO: 5130 - RNA, 19 nt, Artificial Sequence
  Description of Artificial Sequence: Synthetic oligonucleotide
gaccuagaggcacacgucc

SEQ ID NO: 5131 - RNA, 19 nt, Artificial Sequence
  Description of Artificial Sequence: Synthetic oligonucleotide
accuagaggcacacguccg

SEQ ID NO: 5132 - RNA, 19 nt, Artificial Sequence
  Description of Artificial Sequence: Synthetic oligonucleotide
ccuagaggcacacguccgg

SEQ ID NO: 5133 - RNA, 19 nt, Artificial Sequence
  Description of Artificial Sequence: Synthetic oligonucleotide
cuagaggcacacguccggc

SEQ ID NO: 5134 - RNA, 19 nt, Artificial Sequence
  Description of Artificial Sequence: Synthetic oligonucleotide
uagaggcacacguccggca

SEQ ID NO: 5135 - RNA, 19 nt, Artificial Sequence
  Description of Artificial Sequence: Synthetic oligonucleotide
agaggcacacguccggcag

SEQ ID NO: 5136 - RNA, 19 nt, Artificial Sequence
  Description of Artificial Sequence: Synthetic oligonucleotide
gaggcacacguccggcagu

SEQ ID NO: 5137 - RNA, 19 nt, Artificial Sequence
  Description of Artificial Sequence: Synthetic oligonucleotide
aggcacacguccggcaguu

SEQ ID NO: 5138 - RNA, 19 nt, Artificial Sequence
  Description of Artificial Sequence: Synthetic oligonucleotide
ggcacacguccggcaguug

SEQ ID NO: 5139 - RNA, 19 nt, Artificial Sequence
  Description of Artificial Sequence: Synthetic oligonucleotide
gcacacguccggcaguugc

SEQ ID NO: 5140 - RNA, 19 nt, Artificial Sequence
  Description of Artificial Sequence: Synthetic oligonucleotide
cacacguccggcaguugca

SEQ ID NO: 5141 - RNA, 19 nt, Artificial Sequence
  Description of Artificial Sequence: Synthetic oligonucleotide
acacguccggcaguugcag

SEQ ID NO: 5142 - RNA, 19 nt, Artificial Sequence
  Description of Artificial Sequence: Synthetic oligonucleotide
cacguccggcaguugcagg

SEQ ID NO: 5143 - RNA, 19 nt, Artificial Sequence
  Description of Artificial Sequence: Synthetic oligonucleotide
acguccggcaguugcagga

SEQ ID NO: 5144 - RNA, 19 nt, Artificial Sequence
  Description of Artificial Sequence: Synthetic oligonucleotide
cguccggcaguugcaggag

SEQ ID NO: 5145 - RNA, 19 nt, Artificial Sequence
  Description of Artificial Sequence: Synthetic oligonucleotide
guccggcaguugcaggagc

SEQ ID NO: 5146 - RNA, 19 nt, Artificial Sequence
  Description of Artificial Sequence: Synthetic oligonucleotide
uccggcaguugcaggagcg

SEQ ID NO: 5147 - RNA, 19 nt, Artificial Sequence
  Description of Artificial Sequence: Synthetic oligonucleotide
ccggcaguugcaggagcgg

SEQ ID NO: 5148 - RNA, 19 nt, Artificial Sequence
  Description of Artificial Sequence: Synthetic oligonucleotide
cggcaguugcaggagcgga

SEQ ID NO: 5149 - RNA, 19 nt, Artificial Sequence
  Description of Artificial Sequence: Synthetic oligonucleotide
ggcaguugcaggagcggau

SEQ ID NO: 5150 - RNA, 19 nt, Artificial Sequence
  Description of Artificial Sequence: Synthetic oligonucleotide
gcaguugcaggagcggaug

SEQ ID NO: 5151 - RNA, 19 nt, Artificial Sequence
  Description of Artificial Sequence: Synthetic oligonucleotide
caguugcaggagcggaugg

SEQ ID NO: 5152 - RNA, 19 nt, Artificial Sequence
  Description of Artificial Sequence: Synthetic oligonucleotide
aguugcaggagcggaugga

SEQ ID NO: 5153 - RNA, 19 nt, Artificial Sequence
  Description of Artificial Sequence: Synthetic oligonucleotide
guugcaggagcggauggag

SEQ ID NO: 5154 - RNA, 19 nt, Artificial Sequence
  Description of Artificial Sequence: Synthetic oligonucleotide
uugcaggagcggauggagu

SEQ ID NO: 5155 - RNA, 19 nt, Artificial Sequence
  Description of Artificial Sequence: Synthetic oligonucleotide
ugcaggagcggauggaguu

SEQ ID NO: 5156 - RNA, 19 nt, Artificial Sequence
  Description of Artificial Sequence: Synthetic oligonucleotide
gcaggagcggauggaguug

SEQ ID NO: 5157 - RNA, 19 nt, Artificial Sequence
  Description of Artificial Sequence: Synthetic oligonucleotide
caggagcggauggaguugc

SEQ ID NO: 5158 - RNA, 19 nt, Artificial Sequence
  Description of Artificial Sequence: Synthetic oligonucleotide
aggagcggauggaguugcu

SEQ ID NO: 5159 - RNA, 19 nt, Artificial Sequence
  Description of Artificial Sequence: Synthetic oligonucleotide
ggagcggauggaguugcug

SEQ ID NO: 5160 - RNA, 19 nt, Artificial Sequence
  Description of Artificial Sequence: Synthetic oligonucleotide
gagcggauggaguugcugc

SEQ ID NO: 5161 - RNA, 19 nt, Artificial Sequence
  Description of Artificial Sequence: Synthetic oligonucleotide
agcggauggaguugcugca

SEQ ID NO: 5162 - RNA, 19 nt, Artificial Sequence
  Description of Artificial Sequence: Synthetic oligonucleotide
gcggauggaguugcugcag

SEQ ID NO: 5163 - RNA, 19 nt, Artificial Sequence
  Description of Artificial Sequence: Synthetic oligonucleotide
cggauggaguugcugcagg

SEQ ID NO: 5164 - RNA, 19 nt, Artificial Sequence
  Description of Artificial Sequence: Synthetic oligonucleotide
ggauggaguugcugcaggc

SEQ ID NO: 5165 - RNA, 19 nt, Artificial Sequence
  Description of Artificial Sequence: Synthetic oligonucleotide
gauggaguugcugcaggca

SEQ ID NO: 5166 - RNA, 19 nt, Artificial Sequence
  Description of Artificial Sequence: Synthetic oligonucleotide
auggaguugcugcaggcag

SEQ ID NO: 5167 - RNA, 19 nt, Artificial Sequence
  Description of Artificial Sequence: Synthetic oligonucleotide
uggaguugcugcaggcaga

SEQ ID NO: 5168 - RNA, 19 nt, Artificial Sequence
  Description of Artificial Sequence: Synthetic oligonucleotide
ggaguugcugcaggcagag

SEQ ID NO: 5169 - RNA, 19 nt, Artificial Sequence
  Description of Artificial Sequence: Synthetic oligonucleotide
gaguugcugcaggcagagg

SEQ ID NO: 5170 - RNA, 19 nt, Artificial Sequence
  Description of Artificial Sequence: Synthetic oligonucleotide
aguugcugcaggcagaggg

SEQ ID NO: 5171 - RNA, 19 nt, Artificial Sequence
  Description of Artificial Sequence: Synthetic oligonucleotide
guugcugcaggcagaggga

SEQ ID NO: 5172 - RNA, 19 nt, Artificial Sequence
  Description of Artificial Sequence: Synthetic oligonucleotide
uugcugcaggcagagggag

SEQ ID NO: 5173 - RNA, 19 nt, Artificial Sequence
  Description of Artificial Sequence: Synthetic oligonucleotide
ugcugcaggcagagggagc

SEQ ID NO: 5174 - RNA, 19 nt, Artificial Sequence
  Description of Artificial Sequence: Synthetic oligonucleotide
gcugcaggcagagggagcc

SEQ ID NO: 5175 - RNA, 19 nt, Artificial Sequence
  Description of Artificial Sequence: Synthetic oligonucleotide
cugcaggcagagggagcca

SEQ ID NO: 5176 - RNA, 19 nt, Artificial Sequence
  Description of Artificial Sequence: Synthetic oligonucleotide
ugcaggcagagggagccac

SEQ ID NO: 5177 - RNA, 19 nt, Artificial Sequence
  Description of Artificial Sequence: Synthetic oligonucleotide
gcaggcagagggagccaca

SEQ ID NO: 5178 - RNA, 19 nt, Artificial Sequence
  Description of Artificial Sequence: Synthetic oligonucleotide
caggcagagggagccacag

SEQ ID NO: 5179 - RNA, 19 nt, Artificial Sequence
  Description of Artificial Sequence: Synthetic oligonucleotide
aggcagagggagccacagg

SEQ ID NO: 5180 - RNA, 19 nt, Artificial Sequence
  Description of Artificial Sequence: Synthetic oligonucleotide
ggcagagggagccacaggu

SEQ ID NO: 5181 - RNA, 19 nt, Artificial Sequence
  Description of Artificial Sequence: Synthetic oligonucleotide
gcagagggagccacagguc

SEQ ID NO: 5182 - RNA, 19 nt, Artificial Sequence
  Description of Artificial Sequence: Synthetic oligonucleotide
cagagggagccacaggucc

SEQ ID NO: 5183 - RNA, 19 nt, Artificial Sequence
  Description of Artificial Sequence: Synthetic oligonucleotide
agagggagccacagguccc

SEQ ID NO: 5184 - RNA, 19 nt, Artificial Sequence
  Description of Artificial Sequence: Synthetic oligonucleotide
gagggagccacaggucccu

SEQ ID NO: 5185 - RNA, 19 nt, Artificial Sequence
  Description of Artificial Sequence: Synthetic oligonucleotide
agggagccacaggucccua

SEQ ID NO: 5186 - RNA, 19 nt, Artificial Sequence
  Description of Artificial Sequence: Synthetic oligonucleotide
gggagccacaggucccuag

SEQ ID NO: 5187 - RNA, 19 nt, Artificial Sequence
  Description of Artificial Sequence: Synthetic oligonucleotide
ggagccacaggucccuagg

SEQ ID NO: 5188 - RNA, 19 nt, Artificial Sequence
  Description of Artificial Sequence: Synthetic oligonucleotide
gagccacaggucccuaggc

SEQ ID NO: 5189 - RNA, 19 nt, Artificial Sequence
  Description of Artificial Sequence: Synthetic oligonucleotide
agccacaggucccuaggcc

SEQ ID NO: 5190 - RNA, 19 nt, Artificial Sequence
  Description of Artificial Sequence: Synthetic oligonucleotide
gccacaggucccuaggccu

SEQ ID NO: 5191 - RNA, 19 nt, Artificial Sequence
  Description of Artificial Sequence: Synthetic oligonucleotide
ccacaggucccuaggccug

SEQ ID NO: 5192 - RNA, 19 nt, Artificial Sequence
  Description of Artificial Sequence: Synthetic oligonucleotide
cacaggucccuaggccugg

SEQ ID NO: 5193 - RNA, 19 nt, Artificial Sequence
  Description of Artificial Sequence: Synthetic oligonucleotide
acaggucccuaggccuggc

SEQ ID NO: 5194 - RNA, 19 nt, Artificial Sequence
  Description of Artificial Sequence: Synthetic oligonucleotide
caggucccuaggccuggcc

SEQ ID NO: 5195 - RNA, 19 nt, Artificial Sequence
  Description of Artificial Sequence: Synthetic oligonucleotide
aggucccuaggccuggccu

SEQ ID NO: 5196 - RNA, 19 nt, Artificial Sequence
  Description of Artificial Sequence: Synthetic oligonucleotide
ggucccuaggccuggccua

SEQ ID NO: 5197 - RNA, 19 nt, Artificial Sequence
  Description of Artificial Sequence: Synthetic oligonucleotide
gucccuaggccuggccuau

SEQ ID NO: 5198 - RNA, 19 nt, Artificial Sequence
  Description of Artificial Sequence: Synthetic oligonucleotide
ucccuaggccuggccuauc

SEQ ID NO: 5199 - RNA, 19 nt, Artificial Sequence
  Description of Artificial Sequence: Synthetic oligonucleotide
cccuaggccuggccuaucg

SEQ ID NO: 5200 - RNA, 19 nt, Artificial Sequence
  Description of Artificial Sequence: Synthetic oligonucleotide
ccuaggccuggccuaucgg

SEQ ID NO: 5201 - RNA, 19 nt, Artificial Sequence
  Description of Artificial Sequence: Synthetic oligonucleotide
cuaggccuggccuaucgga

SEQ ID NO: 5202 - RNA, 19 nt, Artificial Sequence
  Description of Artificial Sequence: Synthetic oligonucleotide
uaggccuggccuaucggag

SEQ ID NO: 5203 - RNA, 19 nt, Artificial Sequence
  Description of Artificial Sequence: Synthetic oligonucleotide
aggccuggccuaucggagg

SEQ ID NO: 5204 - RNA, 19 nt, Artificial Sequence
  Description of Artificial Sequence: Synthetic oligonucleotide
ggccuggccuaucggaggc

SEQ ID NO: 5205 - RNA, 19 nt, Artificial Sequence
  Description of Artificial Sequence: Synthetic oligonucleotide
gccuggccuaucggaggcg

SEQ ID NO: 5206 - RNA, 19 nt, Artificial Sequence
  Description of Artificial Sequence: Synthetic oligonucleotide
ccuggccuaucggaggcgc

SEQ ID NO: 5207 - RNA, 19 nt, Artificial Sequence
  Description of Artificial Sequence: Synthetic oligonucleotide
cuggccuaucggaggcgcu

SEQ ID NO: 5208 - RNA, 19 nt, Artificial Sequence
  Description of Artificial Sequence: Synthetic oligonucleotide
uggccuaucggaggcgcuu

SEQ ID NO: 5209 - RNA, 19 nt, Artificial Sequence
  Description of Artificial Sequence: Synthetic oligonucleotide
ggccuaucggaggcgcuuu

SEQ ID NO: 5210 - RNA, 19 nt, Artificial Sequence
  Description of Artificial Sequence: Synthetic oligonucleotide
gccuaucggaggcgcuuuc

SEQ ID NO: 5211 - RNA, 19 nt, Artificial Sequence
  Description of Artificial Sequence: Synthetic oligonucleotide
ccuaucggaggcgcuuucc

SEQ ID NO: 5212 - RNA, 19 nt, Artificial Sequence
  Description of Artificial Sequence: Synthetic oligonucleotide
cuaucggaggcgcuuuccc

SEQ ID NO: 5213 - RNA, 19 nt, Artificial Sequence
  Description of Artificial Sequence: Synthetic oligonucleotide
uaucggaggcgcuuucccu

SEQ ID NO: 5214 - RNA, 19 nt, Artificial Sequence
  Description of Artificial Sequence: Synthetic oligonucleotide
aucggaggcgcuuucccug

SEQ ID NO: 5215 - RNA, 19 nt, Artificial Sequence
  Description of Artificial Sequence: Synthetic oligonucleotide
ucggaggcgcuuucccugc

SEQ ID NO: 5216 - RNA, 19 nt, Artificial Sequence
  Description of Artificial Sequence: Synthetic oligonucleotide
cggaggcgcuuucccugcu

SEQ ID NO: 5217 - RNA, 19 nt, Artificial Sequence
  Description of Artificial Sequence: Synthetic oligonucleotide
ggaggcgcuuucccugcuc

SEQ ID NO: 5218 - RNA, 19 nt, Artificial Sequence
  Description of Artificial Sequence: Synthetic oligonucleotide
gaggcgcuuucccugcucc

SEQ ID NO: 5219 - RNA, 19 nt, Artificial Sequence
  Description of Artificial Sequence: Synthetic oligonucleotide
aggcgcuuucccugcuccu

SEQ ID NO: 5220 - RNA, 19 nt, Artificial Sequence
  Description of Artificial Sequence: Synthetic oligonucleotide
ggcgcuuucccugcuccug

SEQ ID NO: 5221 - RNA, 19 nt, Artificial Sequence
  Description of Artificial Sequence: Synthetic oligonucleotide
gcgcuuucccugcuccugu

SEQ ID NO: 5222 - RNA, 19 nt, Artificial Sequence
  Description of Artificial Sequence: Synthetic oligonucleotide
cgcuuucccugcuccuguu

SEQ ID NO: 5223 - RNA, 19 nt, Artificial Sequence
  Description of Artificial Sequence: Synthetic oligonucleotide
gcuuucccugcuccuguuc

SEQ ID NO: 5224 - RNA, 19 nt, Artificial Sequence
  Description of Artificial Sequence: Synthetic oligonucleotide
cuuucccugcuccuguucg

SEQ ID NO: 5225 - RNA, 19 nt, Artificial Sequence
  Description of Artificial Sequence: Synthetic oligonucleotide
uuucccugcuccuguucgc

SEQ ID NO: 5226 - RNA, 19 nt, Artificial Sequence
  Description of Artificial Sequence: Synthetic oligonucleotide
uucccugcuccuguucgcc

SEQ ID NO: 5227 - RNA, 19 nt, Artificial Sequence
  Description of Artificial Sequence: Synthetic oligonucleotide
ucccugcuccuguucgccg

SEQ ID NO: 5228 - RNA, 19 nt, Artificial Sequence
  Description of Artificial Sequence: Synthetic oligonucleotide
cccugcuccuguucgccgu

SEQ ID NO: 5229 - RNA, 19 nt, Artificial Sequence
  Description of Artificial Sequence: Synthetic oligonucleotide
ccugcuccuguucgccguu

SEQ ID NO: 5230 - RNA, 19 nt, Artificial Sequence
  Description of Artificial Sequence: Synthetic oligonucleotide
cugcuccuguucgccguug

SEQ ID NO: 5231 - RNA, 19 nt, Artificial Sequence
  Description of Artificial Sequence: Synthetic oligonucleotide
ugcuccuguucgccguugu

SEQ ID NO: 5232 - RNA, 19 nt, Artificial Sequence
  Description of Artificial Sequence: Synthetic oligonucleotide
gcuccuguucgccguuguu

SEQ ID NO: 5233 - RNA, 19 nt, Artificial Sequence
  Description of Artificial Sequence: Synthetic oligonucleotide
cuccuguucgccguuguuc

SEQ ID NO: 5234 - RNA, 19 nt, Artificial Sequence
  Description of Artificial Sequence: Synthetic oligonucleotide
uccuguucgccguuguucu

SEQ ID NO: 5235 - RNA, 19 nt, Artificial Sequence
  Description of Artificial Sequence: Synthetic oligonucleotide
ccuguucgccguuguucug

SEQ ID NO: 5236 - RNA, 19 nt, Artificial Sequence
  Description of Artificial Sequence: Synthetic oligonucleotide
cuguucgccguuguucugu

SEQ ID NO: 5237 - RNA, 19 nt, Artificial Sequence
  Description of Artificial Sequence: Synthetic oligonucleotide
uguucgccguuguucuguc

SEQ ID NO: 5238 - RNA, 19 nt, Artificial Sequence
  Description of Artificial Sequence: Synthetic oligonucleotide
guucgccguuguucugucu

SEQ ID NO: 5239 - RNA, 19 nt, Artificial Sequence
  Description of Artificial Sequence: Synthetic oligonucleotide
uucgccguuguucugucuc

SEQ ID NO: 5240 - RNA, 19 nt, Artificial Sequence
  Description of Artificial Sequence: Synthetic oligonucleotide
ucgccguuguucugucucg

SEQ ID NO: 5241 - RNA, 19 nt, Artificial Sequence
  Description of Artificial Sequence: Synthetic oligonucleotide
cgccguuguucugucucgu

SEQ ID NO: 5242 - RNA, 19 nt, Artificial Sequence
  Description of Artificial Sequence: Synthetic oligonucleotide
gccguuguucugucucgug

SEQ ID NO: 5243 - RNA, 19 nt, Artificial Sequence
  Description of Artificial Sequence: Synthetic oligonucleotide
ccguuguucugucucgugc

SEQ ID NO: 5244 - RNA, 19 nt, Artificial Sequence
  Description of Artificial Sequence: Synthetic oligonucleotide
cguuguucugucucgugcc

SEQ ID NO: 5245 - RNA, 19 nt, Artificial Sequence
  Description of Artificial Sequence: Synthetic oligonucleotide
guuguucugucucgugccg

SEQ ID NO: 5246 - RNA, 19 nt, Artificial Sequence
  Description of Artificial Sequence: Synthetic oligonucleotide
uuguucugucucgugccgc

SEQ ID NO: 5247 - RNA, 19 nt, Artificial Sequence
  Description of Artificial Sequence: Synthetic oligonucleotide
uguucugucucgugccgcc

SEQ ID NO: 5248 - RNA, 19 nt, Artificial Sequence
  Description of Artificial Sequence: Synthetic oligonucleotide
guucugucucgugccgccg

SEQ ID NO: 5249 - RNA, 19 nt, Artificial Sequence
  Description of Artificial Sequence: Synthetic oligonucleotide
uucugucucgugccgccgc

SEQ ID NO: 5250 - RNA, 19 nt, Artificial Sequence
  Description of Artificial Sequence: Synthetic oligonucleotide
ucugucucgugccgccgcc

SEQ ID NO: 5251 - RNA, 19 nt, Artificial Sequence
  Description of Artificial Sequence: Synthetic oligonucleotide
cugucucgugccgccgccc

SEQ ID NO: 5252 - RNA, 19 nt, Artificial Sequence
  Description of Artificial Sequence: Synthetic oligonucleotide
ugucucgugccgccgcccu

SEQ ID NO: 5253 - RNA, 19 nt, Artificial Sequence
  Description of Artificial Sequence: Synthetic oligonucleotide
gucucgugccgccgcccug

SEQ ID NO: 5254 - RNA, 19 nt, Artificial Sequence
  Description of Artificial Sequence: Synthetic oligonucleotide
ucucgugccgccgcccugg

SEQ ID NO: 5255 - RNA, 19 nt, Artificial Sequence
  Description of Artificial Sequence: Synthetic oligonucleotide
cucgugccgccgcccuggg

SEQ ID NO: 5256 - RNA, 19 nt, Artificial Sequence
  Description of Artificial Sequence: Synthetic oligonucleotide
ucgugccgccgcccugggc

SEQ ID NO: 5257 - RNA, 19 nt, Artificial Sequence
  Description of Artificial Sequence: Synthetic oligonucleotide
cgugccgccgcccugggcu

SEQ ID NO: 5258 - RNA, 19 nt, Artificial Sequence
  Description of Artificial Sequence: Synthetic oligonucleotide
gugccgccgcccugggcug

SEQ ID NO: 5259 - RNA, 19 nt, Artificial Sequence
  Description of Artificial Sequence: Synthetic oligonucleotide
ugccgccgcccugggcugc

SEQ ID NO: 5260 - RNA, 19 nt, Artificial Sequence
  Description of Artificial Sequence: Synthetic oligonucleotide
gccgccgcccugggcugca

SEQ ID NO: 5261 - RNA, 19 nt, Artificial Sequence
  Description of Artificial Sequence: Synthetic oligonucleotide
ccgccgcccugggcugcau

SEQ ID NO: 5262 - RNA, 19 nt, Artificial Sequence
  Description of Artificial Sequence: Synthetic oligonucleotide
cgccgcccugggcugcauu

SEQ ID NO: 5263 - RNA, 19 nt, Artificial Sequence
  Description of Artificial Sequence: Synthetic oligonucleotide
gccgcccugggcugcauug

SEQ ID NO: 5264 - RNA, 19 nt, Artificial Sequence
  Description of Artificial Sequence: Synthetic oligonucleotide
ccgcccugggcugcauugg

SEQ ID NO: 5265 - RNA, 19 nt, Artificial Sequence
  Description of Artificial Sequence: Synthetic oligonucleotide
cgcccugggcugcauuggg

SEQ ID NO: 5266 - RNA, 19 nt, Artificial Sequence
  Description of Artificial Sequence: Synthetic oligonucleotide
gcccugggcugcauugggu

SEQ ID NO: 5267 - RNA, 19 nt, Artificial Sequence
  Description of Artificial Sequence: Synthetic oligonucleotide
cccugggcugcauuggguu

SEQ ID NO: 5268 - RNA, 19 nt, Artificial Sequence
  Description of Artificial Sequence: Synthetic oligonucleotide
ccugggcugcauuggguug

SEQ ID NO: 5269 - RNA, 19 nt, Artificial Sequence
  Description of Artificial Sequence: Synthetic oligonucleotide
cugggcugcauuggguugg

SEQ ID NO: 5270 - RNA, 19 nt, Artificial Sequence
  Description of Artificial Sequence: Synthetic oligonucleotide
ugggcugcauuggguuggu

SEQ ID NO: 5271 - RNA, 19 nt, Artificial Sequence
  Description of Artificial Sequence: Synthetic oligonucleotide
gggcugcauuggguuggug

SEQ ID NO: 5272 - RNA, 19 nt, Artificial Sequence
  Description of Artificial Sequence: Synthetic oligonucleotide
ggcugcauuggguuggugg

SEQ ID NO: 5273 - RNA, 19 nt, Artificial Sequence
  Description of Artificial Sequence: Synthetic oligonucleotide
gcugcauuggguugguggc

SEQ ID NO: 5274 - RNA, 19 nt, Artificial Sequence
  Description of Artificial Sequence: Synthetic oligonucleotide
cugcauuggguugguggcc

SEQ ID NO: 5275 - RNA, 19 nt, Artificial Sequence
  Description of Artificial Sequence: Synthetic oligonucleotide
ugcauuggguugguggccc

SEQ ID NO: 5276 - RNA, 19 nt, Artificial Sequence
  Description of Artificial Sequence: Synthetic oligonucleotide
gcauuggguugguggccca

SEQ ID NO: 5277 - RNA, 19 nt, Artificial Sequence
  Description of Artificial Sequence: Synthetic oligonucleotide
cauuggguugguggcccac

SEQ ID NO: 5278 - RNA, 19 nt, Artificial Sequence
  Description of Artificial Sequence: Synthetic oligonucleotide
auuggguugguggcccacg

SEQ ID NO: 5279 - RNA, 19 nt, Artificial Sequence
  Description of Artificial Sequence: Synthetic oligonucleotide
uuggguugguggcccacgc

SEQ ID NO: 5280 - RNA, 19 nt, Artificial Sequence
  Description of Artificial Sequence: Synthetic oligonucleotide
uggguugguggcccacgcc

SEQ ID NO: 5281 - RNA, 19 nt, Artificial Sequence
  Description of Artificial Sequence: Synthetic oligonucleotide
ggguugguggcccacgccg

SEQ ID NO: 5282 - RNA, 19 nt, Artificial Sequence
  Description of Artificial Sequence: Synthetic oligonucleotide
gguugguggcccacgccgg

SEQ ID NO: 5283 - RNA, 19 nt, Artificial Sequence
  Description of Artificial Sequence: Synthetic oligonucleotide
guugguggcccacgccggc

SEQ ID NO: 5284 - RNA, 19 nt, Artificial Sequence
  Description of Artificial Sequence: Synthetic oligonucleotide
uugguggcccacgccggcc

SEQ ID NO: 5285 - RNA, 19 nt, Artificial Sequence
  Description of Artificial Sequence: Synthetic oligonucleotide
ugguggcccacgccggcca

SEQ ID NO: 5286 - RNA, 19 nt, Artificial Sequence
  Description of Artificial Sequence: Synthetic oligonucleotide
gguggcccacgccggccaa

SEQ ID NO: 5287 - RNA, 19 nt, Artificial Sequence
  Description of Artificial Sequence: Synthetic oligonucleotide
guggcccacgccggccaac

SEQ ID NO: 5288 - RNA, 19 nt, Artificial Sequence
  Description of Artificial Sequence: Synthetic oligonucleotide
uggcccacgccggccaacu

SEQ ID NO: 5289 - RNA, 19 nt, Artificial Sequence
  Description of Artificial Sequence: Synthetic oligonucleotide
ggcccacgccggccaacuc

SEQ ID NO: 5290 - RNA, 19 nt, Artificial Sequence
  Description of Artificial Sequence: Synthetic oligonucleotide
gcccacgccggccaacuca

SEQ ID NO: 5291 - RNA, 19 nt, Artificial Sequence
  Description of Artificial Sequence: Synthetic oligonucleotide
cccacgccggccaacucac

SEQ ID NO: 5292 - RNA, 19 nt, Artificial Sequence
  Description of Artificial Sequence: Synthetic oligonucleotide
ccacgccggccaacucacc

SEQ ID NO: 5293 - RNA, 19 nt, Artificial Sequence
  Description of Artificial Sequence: Synthetic oligonucleotide
cacgccggccaacucaccg

SEQ ID NO: 5294 - RNA, 19 nt, Artificial Sequence
  Description of Artificial Sequence: Synthetic oligonucleotide
acgccggccaacucaccgc

SEQ ID NO: 5295 - RNA, 19 nt, Artificial Sequence
  Description of Artificial Sequence: Synthetic oligonucleotide
cgccggccaacucaccgca

SEQ ID NO: 5296 - RNA, 19 nt, Artificial Sequence
  Description of Artificial Sequence: Synthetic oligonucleotide
gccggccaacucaccgcag

SEQ ID NO: 5297 - RNA, 19 nt, Artificial Sequence
  Description of Artificial Sequence: Synthetic oligonucleotide
ccggccaacucaccgcagu

SEQ ID NO: 5298 - RNA, 19 nt, Artificial Sequence
  Description of Artificial Sequence: Synthetic oligonucleotide
cggccaacucaccgcaguc

SEQ ID NO: 5299 - RNA, 19 nt, Artificial Sequence
  Description of Artificial Sequence: Synthetic oligonucleotide
ggccaacucaccgcagucu

SEQ ID NO: 5300 - RNA, 19 nt, Artificial Sequence
  Description of Artificial Sequence: Synthetic oligonucleotide
gccaacucaccgcagucug

SEQ ID NO: 5301 - RNA, 19 nt, Artificial Sequence
  Description of Artificial Sequence: Synthetic oligonucleotide
ccaacucaccgcagucugg

SEQ ID NO: 5302 - RNA, 19 nt, Artificial Sequence
  Description of Artificial Sequence: Synthetic oligonucleotide
caacucaccgcagucuggc

SEQ ID NO: 5303 - RNA, 19 nt, Artificial Sequence
  Description of Artificial Sequence: Synthetic oligonucleotide
aacucaccgcagucuggcg

SEQ ID NO: 5304 - RNA, 19 nt, Artificial Sequence
  Description of Artificial Sequence: Synthetic oligonucleotide
acucaccgcagucuggcgc

SEQ ID NO: 5305 - RNA, 19 nt, Artificial Sequence
  Description of Artificial Sequence: Synthetic oligonucleotide
cucaccgcagucuggcgcc

SEQ ID NO: 5306 - RNA, 19 nt, Artificial Sequence
  Description of Artificial Sequence: Synthetic oligonucleotide
ucaccgcagucuggcgccg

SEQ ID NO: 5307 - RNA, 19 nt, Artificial Sequence
  Description of Artificial Sequence: Synthetic oligonucleotide
caccgcagucuggcgccgc

SEQ ID NO: 5308 - RNA, 19 nt, Artificial Sequence
  Description of Artificial Sequence: Synthetic oligonucleotide
accgcagucuggcgccgcc

SEQ ID NO: 5309 - RNA, 19 nt, Artificial Sequence
  Description of Artificial Sequence: Synthetic oligonucleotide
ccgcagucuggcgccgccc

SEQ ID NO: 5310 - RNA, 19 nt, Artificial Sequence
  Description of Artificial Sequence: Synthetic oligonucleotide
cgcagucuggcgccgccca

SEQ ID NO: 5311 - RNA, 19 nt, Artificial Sequence
  Description of Artificial Sequence: Synthetic oligonucleotide
gcagucuggcgccgcccag

SEQ ID NO: 5312 - RNA, 19 nt, Artificial Sequence
  Description of Artificial Sequence: Synthetic oligonucleotide
cagucuggcgccgcccagg

SEQ ID NO: 5313 - RNA, 19 nt, Artificial Sequence
  Description of Artificial Sequence: Synthetic oligonucleotide
agucuggcgccgcccagga

SEQ ID NO: 5314 - RNA, 19 nt, Artificial Sequence
  Description of Artificial Sequence: Synthetic oligonucleotide
gucuggcgccgcccaggag

SEQ ID NO: 5315 - RNA, 19 nt, Artificial Sequence
  Description of Artificial Sequence: Synthetic oligonucleotide
ucuggcgccgcccaggagc

SEQ ID NO: 5316 - RNA, 19 nt, Artificial Sequence
  Description of Artificial Sequence: Synthetic oligonucleotide
cuggcgccgcccaggagcc

SEQ ID NO: 5317 - RNA, 19 nt, Artificial Sequence
  Description of Artificial Sequence: Synthetic oligonucleotide
uggcgccgcccaggagccg

SEQ ID NO: 5318 - RNA, 19 nt, Artificial Sequence
  Description of Artificial Sequence: Synthetic oligonucleotide
ggcgccgcccaggagccgc

SEQ ID NO: 5319 - RNA, 19 nt, Artificial Sequence
  Description of Artificial Sequence: Synthetic oligonucleotide
gcgccgcccaggagccgcc

SEQ ID NO: 5320 - RNA, 19 nt, Artificial Sequence
  Description of Artificial Sequence: Synthetic oligonucleotide
cgccgcccaggagccgccc

SEQ ID NO: 5321 - RNA, 19 nt, Artificial Sequence
  Description of Artificial Sequence: Synthetic oligonucleotide
gccgcccaggagccgcccg

SEQ ID NO: 5322 - RNA, 19 nt, Artificial Sequence
  Description of Artificial Sequence: Synthetic oligonucleotide
ccgcccaggagccgcccgc

SEQ ID NO: 5323 - RNA, 19 nt, Artificial Sequence
  Description of Artificial Sequence: Synthetic oligonucleotide
cgcccaggagccgcccgcg

SEQ ID NO: 5324 - RNA, 19 nt, Artificial Sequence
  Description of Artificial Sequence: Synthetic oligonucleotide
gcccaggagccgcccgcgc

SEQ ID NO: 5325 - RNA, 19 nt, Artificial Sequence
  Description of Artificial Sequence: Synthetic oligonucleotide
cccaggagccgcccgcgcu

SEQ ID NO: 5326 - RNA, 19 nt, Artificial Sequence
  Description of Artificial Sequence: Synthetic oligonucleotide
ccaggagccgcccgcgcuc

SEQ ID NO: 5327 - RNA, 19 nt, Artificial Sequence
  Description of Artificial Sequence: Synthetic oligonucleotide
caggagccgcccgcgcucc

SEQ ID NO: 5328 - RNA, 19 nt, Artificial Sequence
  Description of Artificial Sequence: Synthetic oligonucleotide
aggagccgcccgcgcuccc

SEQ ID NO: 5329 - RNA, 19 nt, Artificial Sequence
  Description of Artificial Sequence: Synthetic oligonucleotide
ggagccgcccgcgcucccu

SEQ ID NO: 5330 - RNA, 19 nt, Artificial Sequence
  Description of Artificial Sequence: Synthetic oligonucleotide
gagccgcccgcgcucccug

SEQ ID NO: 5331 - RNA, 19 nt, Artificial Sequence
  Description of Artificial Sequence: Synthetic oligonucleotide
agccgcccgcgcucccuga

SEQ ID NO: 5332 - RNA, 19 nt, Artificial Sequence
  Description of Artificial Sequence: Synthetic oligonucleotide
gccgcccgcgcucccugaa

SEQ ID NO: 5333 - RNA, 19 nt, Artificial Sequence
  Description of Artificial Sequence: Synthetic oligonucleotide
ccgcccgcgcucccugaac

SEQ ID NO: 5334 - RNA, 19 nt, Artificial Sequence
  Description of Artificial Sequence: Synthetic oligonucleotide
cgcccgcgcucccugaacc

SEQ ID NO: 5335 - RNA, 19 nt, Artificial Sequence
  Description of Artificial Sequence: Synthetic oligonucleotide
gcccgcgcucccugaaccc

SEQ ID NO: 5336 - RNA, 19 nt, Artificial Sequence
  Description of Artificial Sequence: Synthetic oligonucleotide
cccgcgcucccugaacccu

SEQ ID NO: 5337 - RNA, 19 nt, Artificial Sequence
  Description of Artificial Sequence: Synthetic oligonucleotide
ccgcgcucccugaacccua

SEQ ID NO: 5338 - RNA, 19 nt, Artificial Sequence
  Description of Artificial Sequence: Synthetic oligonucleotide
cgcgcucccugaacccuag

SEQ ID NO: 5339 - RNA, 19 nt, Artificial Sequence
  Description of Artificial Sequence: Synthetic oligonucleotide
gcgcucccugaacccuaga

SEQ ID NO: 5340 - RNA, 19 nt, Artificial Sequence
  Description of Artificial Sequence: Synthetic oligonucleotide
cgcucccugaacccuagaa

SEQ ID NO: 5341 - RNA, 19 nt, Artificial Sequence
  Description of Artificial Sequence: Synthetic oligonucleotide
gcucccugaacccuagaac

SEQ ID NO: 5342 - RNA, 19 nt, Artificial Sequence
  Description of Artificial Sequence: Synthetic oligonucleotide
cucccugaacccuagaacu

SEQ ID NO: 5343 - RNA, 19 nt, Artificial Sequence
  Description of Artificial Sequence: Synthetic oligonucleotide
ucccugaacccuagaacug

SEQ ID NO: 5344 - RNA, 19 nt, Artificial Sequence
  Description of Artificial Sequence: Synthetic oligonucleotide
cccugaacccuagaacugu

SEQ ID NO: 5345 - RNA, 19 nt, Artificial Sequence
  Description of Artificial Sequence: Synthetic oligonucleotide
ccugaacccuagaacuguc

SEQ ID NO: 5346 - RNA, 19 nt, Artificial Sequence
  Description of Artificial Sequence: Synthetic oligonucleotide
cugaacccuagaacugucu

SEQ ID NO: 5347 - RNA, 19 nt, Artificial Sequence
  Description of Artificial Sequence: Synthetic oligonucleotide
ugaacccuagaacugucuu

SEQ ID NO: 5348 - RNA, 19 nt, Artificial Sequence
  Description of Artificial Sequence: Synthetic oligonucleotide
gaacccuagaacugucuuc

SEQ ID NO: 5349 - RNA, 19 nt, Artificial Sequence
  Description of Artificial Sequence: Synthetic oligonucleotide
aacccuagaacugucuucg

SEQ ID NO: 5350 - RNA, 19 nt, Artificial Sequence
  Description of Artificial Sequence: Synthetic oligonucleotide
acccuagaacugucuucga

SEQ ID NO: 5351 - RNA, 19 nt, Artificial Sequence
  Description of Artificial Sequence: Synthetic oligonucleotide
cccuagaacugucuucgac

SEQ ID NO: 5352 - RNA, 19 nt, Artificial Sequence
  Description of Artificial Sequence: Synthetic oligonucleotide
ccuagaacugucuucgacu

SEQ ID NO: 5353 - RNA, 19 nt, Artificial Sequence
  Description of Artificial Sequence: Synthetic oligonucleotide
cuagaacugucuucgacuc

SEQ ID NO: 5354 - RNA, 19 nt, Artificial Sequence
  Description of Artificial Sequence: Synthetic oligonucleotide
uagaacugucuucgacucc

SEQ ID NO: 5355 - RNA, 19 nt, Artificial Sequence
  Description of Artificial Sequence: Synthetic oligonucleotide
agaacugucuucgacuccg

SEQ ID NO: 5356 - RNA, 19 nt, Artificial Sequence
  Description of Artificial Sequence: Synthetic oligonucleotide
gaacugucuucgacuccgg

SEQ ID NO: 5357 - RNA, 19 nt, Artificial Sequence
  Description of Artificial Sequence: Synthetic oligonucleotide
aacugucuucgacuccggg

SEQ ID NO: 5358 - RNA, 19 nt, Artificial Sequence
  Description of Artificial Sequence: Synthetic oligonucleotide
acugucuucgacuccgggg

SEQ ID NO: 5359 - RNA, 19 nt, Artificial Sequence
  Description of Artificial Sequence: Synthetic oligonucleotide
cugucuucgacuccggggc

SEQ ID NO: 5360 - RNA, 19 nt, Artificial Sequence
  Description of Artificial Sequence: Synthetic oligonucleotide
ugucuucgacuccggggcc

SEQ ID NO: 5361 - RNA, 19 nt, Artificial Sequence
  Description of Artificial Sequence: Synthetic oligonucleotide
gucuucgacuccggggccc

SEQ ID NO: 5362 - RNA, 19 nt, Artificial Sequence
  Description of Artificial Sequence: Synthetic oligonucleotide
ucuucgacuccggggcccc

SEQ ID NO: 5363 - RNA, 19 nt, Artificial Sequence
  Description of Artificial Sequence: Synthetic oligonucleotide
cuucgacuccggggccccg

SEQ ID NO: 5364 - RNA, 19 nt, Artificial Sequence
  Description of Artificial Sequence: Synthetic oligonucleotide
uucgacuccggggccccgu

SEQ ID NO: 5365 - RNA, 19 nt, Artificial Sequence
  Description of Artificial Sequence: Synthetic oligonucleotide
ucgacuccggggccccguu

SEQ ID NO: 5366 - RNA, 19 nt, Artificial Sequence
  Description of Artificial Sequence: Synthetic oligonucleotide
cgacuccggggccccguug

SEQ ID NO: 5367 - RNA, 19 nt, Artificial Sequence
  Description of Artificial Sequence: Synthetic oligonucleotide
gacuccggggccccguugg

SEQ ID NO: 5368 - RNA, 19 nt, Artificial Sequence
  Description of Artificial Sequence: Synthetic oligonucleotide
acuccggggccccguugga

SEQ ID NO: 5369 - RNA, 19 nt, Artificial Sequence
  Description of Artificial Sequence: Synthetic oligonucleotide
cuccggggccccguuggaa

SEQ ID NO: 5370 - RNA, 19 nt, Artificial Sequence
  Description of Artificial Sequence: Synthetic oligonucleotide
uccggggccccguuggaag

SEQ ID NO: 5371 - RNA, 19 nt, Artificial Sequence
  Description of Artificial Sequence: Synthetic oligonucleotide
ccggggccccguuggaaga

SEQ ID NO: 5372 - RNA, 19 nt, Artificial Sequence
  Description of Artificial Sequence: Synthetic oligonucleotide
cggggccccguuggaagac

SEQ ID NO: 5373 - RNA, 19 nt, Artificial Sequence
  Description of Artificial Sequence: Synthetic oligonucleotide
ggggccccguuggaagacu

SEQ ID NO: 5374 - RNA, 19 nt, Artificial Sequence
  Description of Artificial Sequence: Synthetic oligonucleotide
gggccccguuggaagacug

SEQ ID NO: 5375 - RNA, 19 nt, Artificial Sequence
  Description of Artificial Sequence: Synthetic oligonucleotide
ggccccguuggaagacuga

SEQ ID NO: 5376 - RNA, 19 nt, Artificial Sequence
  Description of Artificial Sequence: Synthetic oligonucleotide
gccccguuggaagacugag

SEQ ID NO: 5377 - RNA, 19 nt, Artificial Sequence
  Description of Artificial Sequence: Synthetic oligonucleotide
ccccguuggaagacugagu

SEQ ID NO: 5378 - RNA, 19 nt, Artificial Sequence
  Description of Artificial Sequence: Synthetic oligonucleotide
cccguuggaagacugagug

SEQ ID NO: 5379 - RNA, 19 nt, Artificial Sequence
  Description of Artificial Sequence: Synthetic oligonucleotide
ccguuggaagacugagugc

SEQ ID NO: 5380 - RNA, 19 nt, Artificial Sequence
  Description of Artificial Sequence: Synthetic oligonucleotide
cguuggaagacugagugcc

SEQ ID NO: 5381 - RNA, 19 nt, Artificial Sequence
  Description of Artificial Sequence: Synthetic oligonucleotide
guuggaagacugagugccc

SEQ ID NO: 5382 - RNA, 19 nt, Artificial Sequence
  Description of Artificial Sequence: Synthetic oligonucleotide
uuggaagacugagugcccg

SEQ ID NO: 5383 - RNA, 19 nt, Artificial Sequence
  Description of Artificial Sequence: Synthetic oligonucleotide
uggaagacugagugcccgg

SEQ ID NO: 5384 - RNA, 19 nt, Artificial Sequence
  Description of Artificial Sequence: Synthetic oligonucleotide
ggaagacugagugcccggg

SEQ ID NO: 5385 - RNA, 19 nt, Artificial Sequence
  Description of Artificial Sequence: Synthetic oligonucleotide
gaagacugagugcccgggg

SEQ ID NO: 5386 - RNA, 19 nt, Artificial Sequence
  Description of Artificial Sequence: Synthetic oligonucleotide
aagacugagugcccggggc

SEQ ID NO: 5387 - RNA, 19 nt, Artificial Sequence
  Description of Artificial Sequence: Synthetic oligonucleotide
agacugagugcccggggca

SEQ ID NO: 5388 - RNA, 19 nt, Artificial Sequence
  Description of Artificial Sequence: Synthetic oligonucleotide
gacugagugcccggggcac

SEQ ID NO: 5389 - RNA, 19 nt, Artificial Sequence
  Description of Artificial Sequence: Synthetic oligonucleotide
acugagugcccggggcacg

SEQ ID NO: 5390 - RNA, 19 nt, Artificial Sequence
  Description of Artificial Sequence: Synthetic oligonucleotide
cugagugcccggggcacgg

SEQ ID NO: 5391 - RNA, 19 nt, Artificial Sequence
  Description of Artificial Sequence: Synthetic oligonucleotide
ugagugcccggggcacggc

SEQ ID NO: 5392 - RNA, 19 nt, Artificial Sequence
  Description of Artificial Sequence: Synthetic oligonucleotide
gagugcccggggcacggca

SEQ ID NO: 5393 - RNA, 19 nt, Artificial Sequence
  Description of Artificial Sequence: Synthetic oligonucleotide
agugcccggggcacggcac

SEQ ID NO: 5394 - RNA, 19 nt, Artificial Sequence
  Description of Artificial Sequence: Synthetic oligonucleotide
gugcccggggcacggcaca

SEQ ID NO: 5395 - RNA, 19 nt, Artificial Sequence
  Description of Artificial Sequence: Synthetic oligonucleotide
ugcccggggcacggcacag

SEQ ID NO: 5396 - RNA, 19 nt, Artificial Sequence
  Description of Artificial Sequence: Synthetic oligonucleotide
gcccggggcacggcacaga

SEQ ID NO: 5397 - RNA, 19 nt, Artificial Sequence
  Description of Artificial Sequence: Synthetic oligonucleotide
cccggggcacggcacagaa

SEQ ID NO: 5398 - RNA, 19 nt, Artificial Sequence
  Description of Artificial Sequence: Synthetic oligonucleotide
ccggggcacggcacagaag

SEQ ID NO: 5399 - RNA, 19 nt, Artificial Sequence
  Description of Artificial Sequence: Synthetic oligonucleotide
cggggcacggcacagaagc

SEQ ID NO: 5400 - RNA, 19 nt, Artificial Sequence
  Description of Artificial Sequence: Synthetic oligonucleotide
ggggcacggcacagaagcc

SEQ ID NO: 5401 - RNA, 19 nt, Artificial Sequence
  Description of Artificial Sequence: Synthetic oligonucleotide
gggcacggcacagaagccg

SEQ ID NO: 5402 - RNA, 19 nt, Artificial Sequence
  Description of Artificial Sequence: Synthetic oligonucleotide
ggcacggcacagaagccgc

SEQ ID NO: 5403 - RNA, 19 nt, Artificial Sequence
  Description of Artificial Sequence: Synthetic oligonucleotide
gcacggcacagaagccgcg

SEQ ID NO: 5404 - RNA, 19 nt, Artificial Sequence
  Description of Artificial Sequence: Synthetic oligonucleotide
cacggcacagaagccgcgc

SEQ ID NO: 5405 - RNA, 19 nt, Artificial Sequence
  Description of Artificial Sequence: Synthetic oligonucleotide
acggcacagaagccgcgcc

SEQ ID NO: 5406 - RNA, 19 nt, Artificial Sequence
  Description of Artificial Sequence: Synthetic oligonucleotide
cggcacagaagccgcgccc

SEQ ID NO: 5407 - RNA, 19 nt, Artificial Sequence
  Description of Artificial Sequence: Synthetic oligonucleotide
ggcacagaagccgcgccca

SEQ ID NO: 5408 - RNA, 19 nt, Artificial Sequence
  Description of Artificial Sequence: Synthetic oligonucleotide
gcacagaagccgcgcccac

SEQ ID NO: 5409 - RNA, 19 nt, Artificial Sequence
  Description of Artificial Sequence: Synthetic oligonucleotide
cacagaagccgcgcccacc

SEQ ID NO: 5410 - RNA, 19 nt, Artificial Sequence
  Description of Artificial Sequence: Synthetic oligonucleotide
acagaagccgcgcccaccg

SEQ ID NO: 5411 - RNA, 19 nt, Artificial Sequence
  Description of Artificial Sequence: Synthetic oligonucleotide
cagaagccgcgcccaccgc

SEQ ID NO: 5412 - RNA, 19 nt, Artificial Sequence
  Description of Artificial Sequence: Synthetic oligonucleotide
agaagccgcgcccaccgcc

SEQ ID NO: 5413 - RNA, 19 nt, Artificial Sequence
  Description of Artificial Sequence: Synthetic oligonucleotide
gaagccgcgcccaccgccu

SEQ ID NO: 5414 - RNA, 19 nt, Artificial Sequence
  Description of Artificial Sequence: Synthetic oligonucleotide
aagccgcgcccaccgccug

SEQ ID NO: 5415 - RNA, 19 nt, Artificial Sequence
  Description of Artificial Sequence: Synthetic oligonucleotide
agccgcgcccaccgccugc

SEQ ID NO: 5416 - RNA, 19 nt, Artificial Sequence
  Description of Artificial Sequence: Synthetic oligonucleotide
gccgcgcccaccgccugcc

SEQ ID NO: 5417 - RNA, 19 nt, Artificial Sequence
  Description of Artificial Sequence: Synthetic oligonucleotide
ccgcgcccaccgccugcca

SEQ ID NO: 5418 - RNA, 19 nt, Artificial Sequence
  Description of Artificial Sequence: Synthetic oligonucleotide
cgcgcccaccgccugccag

SEQ ID NO: 5419 - RNA, 19 nt, Artificial Sequence
  Description of Artificial Sequence: Synthetic oligonucleotide
gcgcccaccgccugccagu

SEQ ID NO: 5420 - RNA, 19 nt, Artificial Sequence
  Description of Artificial Sequence: Synthetic oligonucleotide
cgcccaccgccugccaguu

SEQ ID NO: 5421 - RNA, 19 nt, Artificial Sequence
  Description of Artificial Sequence: Synthetic oligonucleotide
gcccaccgccugccaguuc

SEQ ID NO: 5422 - RNA, 19 nt, Artificial Sequence
  Description of Artificial Sequence: Synthetic oligonucleotide
cccaccgccugccaguuca

SEQ ID NO: 5423 - RNA, 19 nt, Artificial Sequence
  Description of Artificial Sequence: Synthetic oligonucleotide
ccaccgccugccaguucac

SEQ ID NO: 5424 - RNA, 19 nt, Artificial Sequence
  Description of Artificial Sequence: Synthetic oligonucleotide
caccgccugccaguucaca

SEQ ID NO: 5425 - RNA, 19 nt, Artificial Sequence
  Description of Artificial Sequence: Synthetic oligonucleotide
accgccugccaguucacaa

SEQ ID NO: 5426 - RNA, 19 nt, Artificial Sequence
  Description of Artificial Sequence: Synthetic oligonucleotide
ccgccugccaguucacaac

SEQ ID NO: 5427 - RNA, 19 nt, Artificial Sequence
  Description of Artificial Sequence: Synthetic oligonucleotide
cgccugccaguucacaacc

SEQ ID NO: 5428 - RNA, 19 nt, Artificial Sequence
  Description of Artificial Sequence: Synthetic oligonucleotide
gccugccaguucacaaccg

SEQ ID NO: 5429 - RNA, 19 nt, Artificial Sequence
  Description of Artificial Sequence: Synthetic oligonucleotide
ccugccaguucacaaccgc

SEQ ID NO: 5430 - RNA, 19 nt, Artificial Sequence
  Description of Artificial Sequence: Synthetic oligonucleotide
cugccaguucacaaccgcu

SEQ ID NO: 5431 - RNA, 19 nt, Artificial Sequence
  Description of Artificial Sequence: Synthetic oligonucleotide
ugccaguucacaaccgcuc

SEQ ID NO: 5432 - RNA, 19 nt, Artificial Sequence
  Description of Artificial Sequence: Synthetic oligonucleotide
gccaguucacaaccgcucc

SEQ ID NO: 5433 - RNA, 19 nt, Artificial Sequence
  Description of Artificial Sequence: Synthetic oligonucleotide
ccaguucacaaccgcuccg

SEQ ID NO: 5434 - RNA, 19 nt, Artificial Sequence
  Description of Artificial Sequence: Synthetic oligonucleotide
caguucacaaccgcuccga

SEQ ID NO: 5435 - RNA, 19 nt, Artificial Sequence
  Description of Artificial Sequence: Synthetic oligonucleotide
aguucacaaccgcuccgag

SEQ ID NO: 5436 - RNA, 19 nt, Artificial Sequence
  Description of Artificial Sequence: Synthetic oligonucleotide
guucacaaccgcuccgagc

SEQ ID NO: 5437 - RNA, 19 nt, Artificial Sequence
  Description of Artificial Sequence: Synthetic oligonucleotide
uucacaaccgcuccgagcg

SEQ ID NO: 5438 - RNA, 19 nt, Artificial Sequence
  Description of Artificial Sequence: Synthetic oligonucleotide
ucacaaccgcuccgagcgu

SEQ ID NO: 5439 - RNA, 19 nt, Artificial Sequence
  Description of Artificial Sequence: Synthetic oligonucleotide
cacaaccgcuccgagcgug

SEQ ID NO: 5440 - RNA, 19 nt, Artificial Sequence
  Description of Artificial Sequence: Synthetic oligonucleotide
acaaccgcuccgagcgugg

SEQ ID NO: 5441 - RNA, 19 nt, Artificial Sequence
  Description of Artificial Sequence: Synthetic oligonucleotide
caaccgcuccgagcguggg

SEQ ID NO: 5442 - RNA, 19 nt, Artificial Sequence
  Description of Artificial Sequence: Synthetic oligonucleotide
aaccgcuccgagcgugggu

SEQ ID NO: 5443 - RNA, 19 nt, Artificial Sequence
  Description of Artificial Sequence: Synthetic oligonucleotide
accgcuccgagcguggguc

SEQ ID NO: 5444 - RNA, 19 nt, Artificial Sequence
  Description of Artificial Sequence: Synthetic oligonucleotide
ccgcuccgagcgugggucu

SEQ ID NO: 5445 - RNA, 19 nt, Artificial Sequence
  Description of Artificial Sequence: Synthetic oligonucleotide
cgcuccgagcgugggucuc

SEQ ID NO: 5446 - RNA, 19 nt, Artificial Sequence
  Description of Artificial Sequence: Synthetic oligonucleotide
gcuccgagcgugggucucc

SEQ ID NO: 5447 - RNA, 19 nt, Artificial Sequence
  Description of Artificial Sequence: Synthetic oligonucleotide
cuccgagcgugggucuccg

SEQ ID NO: 5448 - RNA, 19 nt, Artificial Sequence
  Description of Artificial Sequence: Synthetic oligonucleotide
uccgagcgugggucuccgc

SEQ ID NO: 5449 - RNA, 19 nt, Artificial Sequence
  Description of Artificial Sequence: Synthetic oligonucleotide
ccgagcgugggucuccgcc

SEQ ID NO: 5450 - RNA, 19 nt, Artificial Sequence
  Description of Artificial Sequence: Synthetic oligonucleotide
cgagcgugggucuccgccc

SEQ ID NO: 5451 - RNA, 19 nt, Artificial Sequence
  Description of Artificial Sequence: Synthetic oligonucleotide
gagcgugggucuccgccca

SEQ ID NO: 5452 - RNA, 19 nt, Artificial Sequence
  Description of Artificial Sequence: Synthetic oligonucleotide
agcgugggucuccgcccag

SEQ ID NO: 5453 - RNA, 19 nt, Artificial Sequence
  Description of Artificial Sequence: Synthetic oligonucleotide
gcgugggucuccgcccagc

SEQ ID NO: 5454 - RNA, 19 nt, Artificial Sequence
  Description of Artificial Sequence: Synthetic oligonucleotide
cgugggucuccgcccagcu

SEQ ID NO: 5455 - RNA, 19 nt, Artificial Sequence
  Description of Artificial Sequence: Synthetic oligonucleotide
gugggucuccgcccagcuc

SEQ ID NO: 5456 - RNA, 19 nt, Artificial Sequence
  Description of Artificial Sequence: Synthetic oligonucleotide
ugggucuccgcccagcucc

SEQ ID NO: 5457 - RNA, 19 nt, Artificial Sequence
  Description of Artificial Sequence: Synthetic oligonucleotide
gggucuccgcccagcucca

SEQ ID NO: 5458 - RNA, 19 nt, Artificial Sequence
  Description of Artificial Sequence: Synthetic oligonucleotide
ggucuccgcccagcuccag

SEQ ID NO: 5459 - RNA, 19 nt, Artificial Sequence
  Description of Artificial Sequence: Synthetic oligonucleotide
gucuccgcccagcuccagu

SEQ ID NO: 5460 - RNA, 19 nt, Artificial Sequence
  Description of Artificial Sequence: Synthetic oligonucleotide
ucuccgcccagcuccaguc

SEQ ID NO: 5461 - RNA, 19 nt, Artificial Sequence
  Description of Artificial Sequence: Synthetic oligonucleotide
cuccgcccagcuccagucc

SEQ ID NO: 5462 - RNA, 19 nt, Artificial Sequence
  Description of Artificial Sequence: Synthetic oligonucleotide
uccgcccagcuccaguccu

SEQ ID NO: 5463 - RNA, 19 nt, Artificial Sequence
  Description of Artificial Sequence: Synthetic oligonucleotide
ccgcccagcuccaguccug

SEQ ID NO: 5464 - RNA, 19 nt, Artificial Sequence
  Description of Artificial Sequence: Synthetic oligonucleotide
cgcccagcuccaguccugu

SEQ ID NO: 5465 - RNA, 19 nt, Artificial Sequence
  Description of Artificial Sequence: Synthetic oligonucleotide
gcccagcuccaguccugug

SEQ ID NO: 5466 - RNA, 19 nt, Artificial Sequence
  Description of Artificial Sequence: Synthetic oligonucleotide
cccagcuccaguccuguga

SEQ ID NO: 5467 - RNA, 19 nt, Artificial Sequence
  Description of Artificial Sequence: Synthetic oligonucleotide
ccagcuccaguccugugau

SEQ ID NO: 5468 - RNA, 19 nt, Artificial Sequence
  Description of Artificial Sequence: Synthetic oligonucleotide
cagcuccaguccugugauc

SEQ ID NO: 5469 - RNA, 19 nt, Artificial Sequence
  Description of Artificial Sequence: Synthetic oligonucleotide
agcuccaguccugugaucc

SEQ ID NO: 5470 - RNA, 19 nt, Artificial Sequence
  Description of Artificial Sequence: Synthetic oligonucleotide
gcuccaguccugugauccg

SEQ ID NO: 5471 - RNA, 19 nt, Artificial Sequence
  Description of Artificial Sequence: Synthetic oligonucleotide
cuccaguccugugauccgg

SEQ ID NO: 5472 - RNA, 19 nt, Artificial Sequence
  Description of Artificial Sequence: Synthetic oligonucleotide
uccaguccugugauccggg

SEQ ID NO: 5473 - RNA, 19 nt, Artificial Sequence
  Description of Artificial Sequence: Synthetic oligonucleotide
ccaguccugugauccgggc

SEQ ID NO: 5474 - RNA, 19 nt, Artificial Sequence
  Description of Artificial Sequence: Synthetic oligonucleotide
caguccugugauccgggcc

SEQ ID NO: 5475 - RNA, 19 nt, Artificial Sequence
  Description of Artificial Sequence: Synthetic oligonucleotide
aguccugugauccgggccc

SEQ ID NO: 5476 - RNA, 19 nt, Artificial Sequence
  Description of Artificial Sequence: Synthetic oligonucleotide
guccugugauccgggcccg

SEQ ID NO: 5477 - RNA, 19 nt, Artificial Sequence
  Description of Artificial Sequence: Synthetic oligonucleotide
uccugugauccgggcccgc

SEQ ID NO: 5478 - RNA, 19 nt, Artificial Sequence
  Description of Artificial Sequence: Synthetic oligonucleotide
ccugugauccgggcccgcc

SEQ ID NO: 5479 - RNA, 19 nt, Artificial Sequence
  Description of Artificial Sequence: Synthetic oligonucleotide
cugugauccgggcccgccc

SEQ ID NO: 5480 - RNA, 19 nt, Artificial Sequence
  Description of Artificial Sequence: Synthetic oligonucleotide
ugugauccgggcccgcccc

SEQ ID NO: 5481 - RNA, 19 nt, Artificial Sequence
  Description of Artificial Sequence: Synthetic oligonucleotide
gugauccgggcccgccccc

SEQ ID NO: 5482 - RNA, 19 nt, Artificial Sequence
  Description of Artificial Sequence: Synthetic oligonucleotide
ugauccgggcccgcccccu

SEQ ID NO: 5483 - RNA, 19 nt, Artificial Sequence
  Description of Artificial Sequence: Synthetic oligonucleotide
gauccgggcccgcccccua

SEQ ID NO: 5484 - RNA, 19 nt, Artificial Sequence
  Description of Artificial Sequence: Synthetic oligonucleotide
auccgggcccgcccccuag

SEQ ID NO: 5485 - RNA, 19 nt, Artificial Sequence
  Description of Artificial Sequence: Synthetic oligonucleotide
uccgggcccgcccccuagc

SEQ ID NO: 5486 - RNA, 19 nt, Artificial Sequence
  Description of Artificial Sequence: Synthetic oligonucleotide
ccgggcccgcccccuagcg

SEQ ID NO: 5487 - RNA, 19 nt, Artificial Sequence
  Description of Artificial Sequence: Synthetic oligonucleotide
cgggcccgcccccuagcgg

SEQ ID NO: 5488 - RNA, 19 nt, Artificial Sequence
  Description of Artificial Sequence: Synthetic oligonucleotide
gggcccgcccccuagcggc

SEQ ID NO: 5489 - RNA, 19 nt, Artificial Sequence
  Description of Artificial Sequence: Synthetic oligonucleotide
ggcccgcccccuagcggcc

SEQ ID NO: 5490 - RNA, 19 nt, Artificial Sequence
  Description of Artificial Sequence: Synthetic oligonucleotide
gcccgcccccuagcggccg

SEQ ID NO: 5491 - RNA, 19 nt, Artificial Sequence
  Description of Artificial Sequence: Synthetic oligonucleotide
cccgcccccuagcggccgg

SEQ ID NO: 5492 - RNA, 19 nt, Artificial Sequence
  Description of Artificial Sequence: Synthetic oligonucleotide
ccgcccccuagcggccggg

SEQ ID NO: 5493 - RNA, 19 nt, Artificial Sequence
  Description of Artificial Sequence: Synthetic oligonucleotide
cgcccccuagcggccgggg

SEQ ID NO: 5494 - RNA, 19 nt, Artificial Sequence
  Description of Artificial Sequence: Synthetic oligonucleotide
gcccccuagcggccgggga

SEQ ID NO: 5495 - RNA, 19 nt, Artificial Sequence
  Description of Artificial Sequence: Synthetic oligonucleotide
cccccuagcggccggggag

SEQ ID NO: 5496 - RNA, 19 nt, Artificial Sequence
  Description of Artificial Sequence: Synthetic oligonucleotide
ccccuagcggccggggagg

SEQ ID NO: 5497 - RNA, 19 nt, Artificial Sequence
  Description of Artificial Sequence: Synthetic oligonucleotide
cccuagcggccggggaggg

SEQ ID NO: 5498 - RNA, 19 nt, Artificial Sequence
  Description of Artificial Sequence: Synthetic oligonucleotide
ccuagcggccggggaggga

SEQ ID NO: 5499 - RNA, 19 nt, Artificial Sequence
  Description of Artificial Sequence: Synthetic oligonucleotide
cuagcggccggggagggag

SEQ ID NO: 5500 - RNA, 19 nt, Artificial Sequence
  Description of Artificial Sequence: Synthetic oligonucleotide
uagcggccggggagggagg

SEQ ID NO: 5501 - RNA, 19 nt, Artificial Sequence
  Description of Artificial Sequence: Synthetic oligonucleotide
agcggccggggagggaggg

SEQ ID NO: 5502 - RNA, 19 nt, Artificial Sequence
  Description of Artificial Sequence: Synthetic oligonucleotide
gcggccggggagggagggg

SEQ ID NO: 5503 - RNA, 19 nt, Artificial Sequence
  Description of Artificial Sequence: Synthetic oligonucleotide
cggccggggagggaggggc

SEQ ID NO: 5504 - RNA, 19 nt, Artificial Sequence
  Description of Artificial Sequence: Synthetic oligonucleotide
ggccggggagggaggggcc

SEQ ID NO: 5505 - RNA, 19 nt, Artificial Sequence
  Description of Artificial Sequence: Synthetic oligonucleotide
gccggggagggaggggccg

SEQ ID NO: 5506 - RNA, 19 nt, Artificial Sequence
  Description of Artificial Sequence: Synthetic oligonucleotide
ccggggagggaggggccgg

SEQ ID NO: 5507 - RNA, 19 nt, Artificial Sequence
  Description of Artificial Sequence: Synthetic oligonucleotide
cggggagggaggggccggg

SEQ ID NO: 5508 - RNA, 19 nt, Artificial Sequence
  Description of Artificial Sequence: Synthetic oligonucleotide
ggggagggaggggccgggu

SEQ ID NO: 5509 - RNA, 19 nt, Artificial Sequence
  Description of Artificial Sequence: Synthetic oligonucleotide
gggagggaggggccggguc

SEQ ID NO: 5510 - RNA, 19 nt, Artificial Sequence
  Description of Artificial Sequence: Synthetic oligonucleotide
ggagggaggggccgggucc

SEQ ID NO: 5511 - RNA, 19 nt, Artificial Sequence
  Description of Artificial Sequence: Synthetic oligonucleotide
gagggaggggccggguccg

SEQ ID NO: 5512 - RNA, 19 nt, Artificial Sequence
  Description of Artificial Sequence: Synthetic oligonucleotide
agggaggggccggguccgc

SEQ ID NO: 5513 - RNA, 19 nt, Artificial Sequence
  Description of Artificial Sequence: Synthetic oligonucleotide
gggaggggccggguccgcg

SEQ ID NO: 5514 - RNA, 19 nt, Artificial Sequence
  Description of Artificial Sequence: Synthetic oligonucleotide
ggaggggccggguccgcgg

SEQ ID NO: 5515 - RNA, 19 nt, Artificial Sequence
  Description of Artificial Sequence: Synthetic oligonucleotide
gaggggccggguccgcggc

SEQ ID NO: 5516 - RNA, 19 nt, Artificial Sequence
  Description of Artificial Sequence: Synthetic oligonucleotide
aggggccggguccgcggcc

SEQ ID NO: 5517 - RNA, 19 nt, Artificial Sequence
  Description of Artificial Sequence: Synthetic oligonucleotide
ggggccggguccgcggccg

SEQ ID NO: 5518 - RNA, 19 nt, Artificial Sequence
  Description of Artificial Sequence: Synthetic oligonucleotide
gggccggguccgcggccgg

SEQ ID NO: 5519 - RNA, 19 nt, Artificial Sequence
  Description of Artificial Sequence: Synthetic oligonucleotide
ggccggguccgcggccggc

SEQ ID NO: 5520 - RNA, 19 nt, Artificial Sequence
  Description of Artificial Sequence: Synthetic oligonucleotide
gccggguccgcggccggcg

SEQ ID NO: 5521 - RNA, 19 nt, Artificial Sequence
  Description of Artificial Sequence: Synthetic oligonucleotide
ccggguccgcggccggcga

SEQ ID NO: 5522 - RNA, 19 nt, Artificial Sequence
  Description of Artificial Sequence: Synthetic oligonucleotide
cggguccgcggccggcgaa

SEQ ID NO: 5523 - RNA, 19 nt, Artificial Sequence
  Description of Artificial Sequence: Synthetic oligonucleotide
ggguccgcggccggcgaac

SEQ ID NO: 5524 - RNA, 19 nt, Artificial Sequence
  Description of Artificial Sequence: Synthetic oligonucleotide
gguccgcggccggcgaacg

SEQ ID NO: 5525 - RNA, 19 nt, Artificial Sequence
  Description of Artificial Sequence: Synthetic oligonucleotide
guccgcggccggcgaacgg

SEQ ID NO: 5526 - RNA, 19 nt, Artificial Sequence
  Description of Artificial Sequence: Synthetic oligonucleotide
uccgcggccggcgaacggg

SEQ ID NO: 5527 - RNA, 19 nt, Artificial Sequence
  Description of Artificial Sequence: Synthetic oligonucleotide
ccgcggccggcgaacgggg

SEQ ID NO: 5528 - RNA, 19 nt, Artificial Sequence
  Description of Artificial Sequence: Synthetic oligonucleotide
cgcggccggcgaacggggc

SEQ ID NO: 5529 - RNA, 19 nt, Artificial Sequence
  Description of Artificial Sequence: Synthetic oligonucleotide
gcggccggcgaacggggcu

SEQ ID NO: 5530 - RNA, 19 nt, Artificial Sequence
  Description of Artificial Sequence: Synthetic oligonucleotide
cggccggcgaacggggcuc

SEQ ID NO: 5531 - RNA, 19 nt, Artificial Sequence
  Description of Artificial Sequence: Synthetic oligonucleotide
ggccggcgaacggggcucg

SEQ ID NO: 5532 - RNA, 19 nt, Artificial Sequence
  Description of Artificial Sequence: Synthetic oligonucleotide
gccggcgaacggggcucga

SEQ ID NO: 5533 - RNA, 19 nt, Artificial Sequence
  Description of Artificial Sequence: Synthetic oligonucleotide
ccggcgaacggggcucgaa

SEQ ID NO: 5534 - RNA, 19 nt, Artificial Sequence
  Description of Artificial Sequence: Synthetic oligonucleotide
cggcgaacggggcucgaag

SEQ ID NO: 5535 - RNA, 19 nt, Artificial Sequence
  Description of Artificial Sequence: Synthetic oligonucleotide
ggcgaacggggcucgaagg

SEQ ID NO: 5536 - RNA, 19 nt, Artificial Sequence
  Description of Artificial Sequence: Synthetic oligonucleotide
gcgaacggggcucgaaggg

SEQ ID NO: 5537 - RNA, 19 nt, Artificial Sequence
  Description of Artificial Sequence: Synthetic oligonucleotide
cgaacggggcucgaagggu

SEQ ID NO: 5538 - RNA, 19 nt, Artificial Sequence
  Description of Artificial Sequence: Synthetic oligonucleotide
gaacggggcucgaaggguc

SEQ ID NO: 5539 - RNA, 19 nt, Artificial Sequence
  Description of Artificial Sequence: Synthetic oligonucleotide
aacggggcucgaagggucc

SEQ ID NO: 5540 - RNA, 19 nt, Artificial Sequence
  Description of Artificial Sequence: Synthetic oligonucleotide
acggggcucgaaggguccu

SEQ ID NO: 5541 - RNA, 19 nt, Artificial Sequence
  Description of Artificial Sequence: Synthetic oligonucleotide
cggggcucgaaggguccuu

SEQ ID NO: 5542 - RNA, 19 nt, Artificial Sequence
  Description of Artificial Sequence: Synthetic oligonucleotide
ggggcucgaaggguccuug

SEQ ID NO: 5543 - RNA, 19 nt, Artificial Sequence
  Description of Artificial Sequence: Synthetic oligonucleotide
gggcucgaaggguccuugu

SEQ ID NO: 5544 - RNA, 19 nt, Artificial Sequence
  Description of Artificial Sequence: Synthetic oligonucleotide
ggcucgaaggguccuugua

SEQ ID NO: 5545 - RNA, 19 nt, Artificial Sequence
  Description of Artificial Sequence: Synthetic oligonucleotide
gcucgaaggguccuuguag

SEQ ID NO: 5546 - RNA, 19 nt, Artificial Sequence
  Description of Artificial Sequence: Synthetic oligonucleotide
cucgaaggguccuuguagc

SEQ ID NO: 5547 - RNA, 19 nt, Artificial Sequence
  Description of Artificial Sequence: Synthetic oligonucleotide
ucgaaggguccuuguagcc

SEQ ID NO: 5548 - RNA, 19 nt, Artificial Sequence
  Description of Artificial Sequence: Synthetic oligonucleotide
cgaaggguccuuguagccg

SEQ ID NO: 5549 - RNA, 19 nt, Artificial Sequence
  Description of Artificial Sequence: Synthetic oligonucleotide
gaaggguccuuguagccgg

SEQ ID NO: 5550 - RNA, 19 nt, Artificial Sequence
  Description of Artificial Sequence: Synthetic oligonucleotide
aaggguccuuguagccggg

SEQ ID NO: 5551 - RNA, 19 nt, Artificial Sequence
  Description of Artificial Sequence: Synthetic oligonucleotide
aggguccuuguagccggga

SEQ ID NO: 5552 - RNA, 19 nt, Artificial Sequence
  Description of Artificial Sequence: Synthetic oligonucleotide
ggguccuuguagccgggaa

SEQ ID NO: 5553 - RNA, 19 nt, Artificial Sequence
  Description of Artificial Sequence: Synthetic oligonucleotide
gguccuuguagccgggaau

SEQ ID NO: 5554 - RNA, 19 nt, Artificial Sequence
  Description of Artificial Sequence: Synthetic oligonucleotide
guccuuguagccgggaaug

SEQ ID NO: 5555 - RNA, 19 nt, Artificial Sequence
  Description of Artificial Sequence: Synthetic oligonucleotide
uccuuguagccgggaaugc

SEQ ID NO: 5556 - RNA, 19 nt, Artificial Sequence
  Description of Artificial Sequence: Synthetic oligonucleotide
ccuuguagccgggaaugcu

SEQ ID NO: 5557 - RNA, 19 nt, Artificial Sequence
  Description of Artificial Sequence: Synthetic oligonucleotide
cuuguagccgggaaugcug

SEQ ID NO: 5558 - RNA, 19 nt, Artificial Sequence
  Description of Artificial Sequence: Synthetic oligonucleotide
uuguagccgggaaugcugc

SEQ ID NO: 5559 - RNA, 19 nt, Artificial Sequence
  Description of Artificial Sequence: Synthetic oligonucleotide
uguagccgggaaugcugcu

SEQ ID NO: 5560 - RNA, 19 nt, Artificial Sequence
  Description of Artificial Sequence: Synthetic oligonucleotide
guagccgggaaugcugcug

SEQ ID NO: 5561 - RNA, 19 nt, Artificial Sequence
  Description of Artificial Sequence: Synthetic oligonucleotide
uagccgggaaugcugcugc

SEQ ID NO: 5562 - RNA, 19 nt, Artificial Sequence
  Description of Artificial Sequence: Synthetic oligonucleotide
agccgggaaugcugcugcu

SEQ ID NO: 5563 - RNA, 19 nt, Artificial Sequence
  Description of Artificial Sequence: Synthetic oligonucleotide
gccgggaaugcugcugcug

SEQ ID NO: 5564 - RNA, 19 nt, Artificial Sequence
  Description of Artificial Sequence: Synthetic oligonucleotide
ccgggaaugcugcugcugc

SEQ ID NO: 5565 - RNA, 19 nt, Artificial Sequence
  Description of Artificial Sequence: Synthetic oligonucleotide
cgggaaugcugcugcugcu

SEQ ID NO: 5566 - RNA, 19 nt, Artificial Sequence
  Description of Artificial Sequence: Synthetic oligonucleotide
gggaaugcugcugcugcug

SEQ ID NO: 5567 - RNA, 19 nt, Artificial Sequence
  Description of Artificial Sequence: Synthetic oligonucleotide
ggaaugcugcugcugcugc

SEQ ID NO: 5568 - RNA, 19 nt, Artificial Sequence
  Description of Artificial Sequence: Synthetic oligonucleotide
gaaugcugcugcugcugcu

SEQ ID NO: 5569 - RNA, 19 nt, Artificial Sequence
  Description of Artificial Sequence: Synthetic oligonucleotide
aaugcugcugcugcugcug

SEQ ID NO: 5570 - RNA, 19 nt, Artificial Sequence
  Description of Artificial Sequence: Synthetic oligonucleotide
augcugcugcugcugcugc

SEQ ID NO: 5571 - RNA, 19 nt, Artificial Sequence
  Description of Artificial Sequence: Synthetic oligonucleotide
ugcugcugcugcugcugcu

SEQ ID NO: 5572 - RNA, 19 nt, Artificial Sequence
  Description of Artificial Sequence: Synthetic oligonucleotide
gcugcugcugcugcugcug

SEQ ID NO: 5573 - RNA, 19 nt, Artificial Sequence
  Description of Artificial Sequence: Synthetic oligonucleotide
cugcugcugcugcugcugc

SEQ ID NO: 5574 - RNA, 19 nt, Artificial Sequence
  Description of Artificial Sequence: Synthetic oligonucleotide
ugcugcugcugcugcugcu

SEQ ID NO: 5575 - RNA, 19 nt, Artificial Sequence
  Description of Artificial Sequence: Synthetic oligonucleotide
gcugcugcugcugcugcug

SEQ ID NO: 5576 - RNA, 19 nt, Artificial Sequence
  Description of Artificial Sequence: Synthetic oligonucleotide
cugcugcugcugcugcugc

SEQ ID NO: 5577 - RNA, 19 nt, Artificial Sequence
  Description of Artificial Sequence: Synthetic oligonucleotide
ugcugcugcugcugcugcu

SEQ ID NO: 5578 - RNA, 19 nt, Artificial Sequence
  Description of Artificial Sequence: Synthetic oligonucleotide
gcugcugcugcugcugcug

SEQ ID NO: 5579 - RNA, 19 nt, Artificial Sequence
  Description of Artificial Sequence: Synthetic oligonucleotide
cugcugcugcugcugcugc

SEQ ID NO: 5580 - RNA, 19 nt, Artificial Sequence
  Description of Artificial Sequence: Synthetic oligonucleotide
ugcugcugcugcugcugcu

SEQ ID NO: 5581 - RNA, 19 nt, Artificial Sequence
  Description of Artificial Sequence: Synthetic oligonucleotide
gcugcugcugcugcugcug

SEQ ID NO: 5582 - RNA, 19 nt, Artificial Sequence
  Description of Artificial Sequence: Synthetic oligonucleotide
cugcugcugcugcugcugc

SEQ ID NO: 5583 - RNA, 19 nt, Artificial Sequence
  Description of Artificial Sequence: Synthetic oligonucleotide
ugcugcugcugcugcugcu

SEQ ID NO: 5584 - RNA, 19 nt, Artificial Sequence
  Description of Artificial Sequence: Synthetic oligonucleotide
gcugcugcugcugcugcug

SEQ ID NO: 5585 - RNA, 19 nt, Artificial Sequence
  Description of Artificial Sequence: Synthetic oligonucleotide
cugcugcugcugcugcugc

SEQ ID NO: 5586 - RNA, 19 nt, Artificial Sequence
  Description of Artificial Sequence: Synthetic oligonucleotide
ugcugcugcugcugcugcu

SEQ ID NO: 5587 - RNA, 19 nt, Artificial Sequence
  Description of Artificial Sequence: Synthetic oligonucleotide
gcugcugcugcugcugcug

SEQ ID NO: 5588 - RNA, 19 nt, Artificial Sequence
  Description of Artificial Sequence: Synthetic oligonucleotide
cugcugcugcugcugcugc

SEQ ID NO: 5589 - RNA, 19 nt, Artificial Sequence
  Description of Artificial Sequence: Synthetic oligonucleotide
ugcugcugcugcugcugcu

SEQ ID NO: 5590 - RNA, 19 nt, Artificial Sequence
  Description of Artificial Sequence: Synthetic oligonucleotide
gcugcugcugcugcugcug

SEQ ID NO: 5591 - RNA, 19 nt, Artificial Sequence
  Description of Artificial Sequence: Synthetic oligonucleotide
cugcugcugcugcugcugc

SEQ ID NO: 5592 - RNA, 19 nt, Artificial Sequence
  Description of Artificial Sequence: Synthetic oligonucleotide
ugcugcugcugcugcugcu

SEQ ID NO: 5593 - RNA, 19 nt, Artificial Sequence
  Description of Artificial Sequence: Synthetic oligonucleotide
gcugcugcugcugcugcug

SEQ ID NO: 5594 - RNA, 19 nt, Artificial Sequence
  Description of Artificial Sequence: Synthetic oligonucleotide
cugcugcugcugcugcugc

SEQ ID NO: 5595 - RNA, 19 nt, Artificial Sequence
  Description of Artificial Sequence: Synthetic oligonucleotide
ugcugcugcugcugcugcu

SEQ ID NO: 5596 - RNA, 19 nt, Artificial Sequence
  Description of Artificial Sequence: Synthetic oligonucleotide
gcugcugcugcugcugcug

SEQ ID NO: 5597 - RNA, 19 nt, Artificial Sequence
  Description of Artificial Sequence: Synthetic oligonucleotide
cugcugcugcugcugcugc

SEQ ID NO: 5598 - RNA, 19 nt, Artificial Sequence
  Description of Artificial Sequence: Synthetic oligonucleotide
ugcugcugcugcugcugcu

SEQ ID NO: 5599 - RNA, 19 nt, Artificial Sequence
  Description of Artificial Sequence: Synthetic oligonucleotide
gcugcugcugcugcugcug

SEQ ID NO: 5600 - RNA, 19 nt, Artificial Sequence
  Description of Artificial Sequence: Synthetic oligonucleotide
cugcugcugcugcugcugc

SEQ ID NO: 5601 - RNA, 19 nt, Artificial Sequence
  Description of Artificial Sequence: Synthetic oligonucleotide
ugcugcugcugcugcugcu

SEQ ID NO: 5602 - RNA, 19 nt, Artificial Sequence
  Description of Artificial Sequence: Synthetic oligonucleotide
gcugcugcugcugcugcug

SEQ ID NO: 5603 - RNA, 19 nt, Artificial Sequence
  Description of Artificial Sequence: Synthetic oligonucleotide
cugcugcugcugcugcugc

SEQ ID NO: 5604 - RNA, 19 nt, Artificial Sequence
  Description of Artificial Sequence: Synthetic oligonucleotide
ugcugcugcugcugcugcu

SEQ ID NO: 5605 - RNA, 19 nt, Artificial Sequence
  Description of Artificial Sequence: Synthetic oligonucleotide
gcugcugcugcugcugcug

SEQ ID NO: 5606 - RNA, 19 nt, Artificial Sequence
  Description of Artificial Sequence: Synthetic oligonucleotide
cugcugcugcugcugcugc

SEQ ID NO: 5607 - RNA, 19 nt, Artificial Sequence
  Description of Artificial Sequence: Synthetic oligonucleotide
ugcugcugcugcugcugcu

SEQ ID NO: 5608 - RNA, 19 nt, Artificial Sequence
  Description of Artificial Sequence: Synthetic oligonucleotide
gcugcugcugcugcugcug

SEQ ID NO: 5609 - RNA, 19 nt, Artificial Sequence
  Description of Artificial Sequence: Synthetic oligonucleotide
cugcugcugcugcugcugc

SEQ ID NO: 5610 - RNA, 19 nt, Artificial Sequence
  Description of Artificial Sequence: Synthetic oligonucleotide
ugcugcugcugcugcugcu

SEQ ID NO: 5611 - RNA, 19 nt, Artificial Sequence
  Description of Artificial Sequence: Synthetic oligonucleotide
gcugcugcugcugcugcug

SEQ ID NO: 5612 - RNA, 19 nt, Artificial Sequence
  Description of Artificial Sequence: Synthetic oligonucleotide
cugcugcugcugcugcugc

SEQ ID NO: 5613 - RNA, 19 nt, Artificial Sequence
  Description of Artificial Sequence: Synthetic oligonucleotide
ugcugcugcugcugcugcu

SEQ ID NO: 5614 - RNA, 19 nt, Artificial Sequence
  Description of Artificial Sequence: Synthetic oligonucleotide
gcugcugcugcugcugcug

SEQ ID NO: 5615 - RNA, 19 nt, Artificial Sequence
  Description of Artificial Sequence: Synthetic oligonucleotide
cugcugcugcugcugcugg

SEQ ID NO: 5616 - RNA, 19 nt, Artificial Sequence
  Description of Artificial Sequence: Synthetic oligonucleotide
ugcugcugcugcugcuggg

SEQ ID NO: 5617 - RNA, 19 nt, Artificial Sequence
  Description of Artificial Sequence: Synthetic oligonucleotide
gcugcugcugcugcugggg

SEQ ID NO: 5618 - RNA, 19 nt, Artificial Sequence
  Description of Artificial Sequence: Synthetic oligonucleotide
cugcugcugcugcuggggg

SEQ ID NO: 5619 - RNA, 19 nt, Artificial Sequence
  Description of Artificial Sequence: Synthetic oligonucleotide
ugcugcugcugcugggggg

SEQ ID NO: 5620 - RNA, 19 nt, Artificial Sequence
  Description of Artificial Sequence: Synthetic oligonucleotide
gcugcugcugcugggggga

SEQ ID NO: 5621 - RNA, 19 nt, Artificial Sequence
  Description of Artificial Sequence: Synthetic oligonucleotide
cugcugcugcuggggggau

SEQ ID NO: 5622 - RNA, 19 nt, Artificial Sequence
  Description of Artificial Sequence: Synthetic oligonucleotide
ugcugcugcuggggggauc

SEQ ID NO: 5623 - RNA, 19 nt, Artificial Sequence
  Description of Artificial Sequence: Synthetic oligonucleotide
gcugcugcuggggggauca

SEQ ID NO: 5624 - RNA, 19 nt, Artificial Sequence
  Description of Artificial Sequence: Synthetic oligonucleotide
cugcugcuggggggaucac

SEQ ID NO: 5625 - RNA, 19 nt, Artificial Sequence
  Description of Artificial Sequence: Synthetic oligonucleotide
ugcugcuggggggaucaca

SEQ ID NO: 5626 - RNA, 19 nt, Artificial Sequence
  Description of Artificial Sequence: Synthetic oligonucleotide
gcugcuggggggaucacag

SEQ ID NO: 5627 - RNA, 19 nt, Artificial Sequence
  Description of Artificial Sequence: Synthetic oligonucleotide
cugcuggggggaucacaga

SEQ ID NO: 5628 - RNA, 19 nt, Artificial Sequence
  Description of Artificial Sequence: Synthetic oligonucleotide
ugcuggggggaucacagac

SEQ ID NO: 5629 - RNA, 19 nt, Artificial Sequence
  Description of Artificial Sequence: Synthetic oligonucleotide
gcuggggggaucacagacc

SEQ ID NO: 5630 - RNA, 19 nt, Artificial Sequence
  Description of Artificial Sequence: Synthetic oligonucleotide
cuggggggaucacagacca

SEQ ID NO: 5631 - RNA, 19 nt, Artificial Sequence
  Description of Artificial Sequence: Synthetic oligonucleotide
uggggggaucacagaccau

SEQ ID NO: 5632 - RNA, 19 nt, Artificial Sequence
  Description of Artificial Sequence: Synthetic oligonucleotide
ggggggaucacagaccauu

SEQ ID NO: 5633 - RNA, 19 nt, Artificial Sequence
  Description of Artificial Sequence: Synthetic oligonucleotide
gggggaucacagaccauuu

SEQ ID NO: 5634 - RNA, 19 nt, Artificial Sequence
  Description of Artificial Sequence: Synthetic oligonucleotide
ggggaucacagaccauuuc

SEQ ID NO: 5635 - RNA, 19 nt, Artificial Sequence
  Description of Artificial Sequence: Synthetic oligonucleotide
gggaucacagaccauuucu

SEQ ID NO: 5636 - RNA, 19 nt, Artificial Sequence
  Description of Artificial Sequence: Synthetic oligonucleotide
ggaucacagaccauuucuu

SEQ ID NO: 5637 - RNA, 19 nt, Artificial Sequence
  Description of Artificial Sequence: Synthetic oligonucleotide
gaucacagaccauuucuuu

SEQ ID NO: 5638 - RNA, 19 nt, Artificial Sequence
  Description of Artificial Sequence: Synthetic oligonucleotide
aucacagaccauuucuuuc

SEQ ID NO: 5639 - RNA, 19 nt, Artificial Sequence
  Description of Artificial Sequence: Synthetic oligonucleotide
ucacagaccauuucuuucu

SEQ ID NO: 5640 - RNA, 19 nt, Artificial Sequence
  Description of Artificial Sequence: Synthetic oligonucleotide
cacagaccauuucuuucuu

SEQ ID NO: 5641 - RNA, 19 nt, Artificial Sequence
  Description of Artificial Sequence: Synthetic oligonucleotide
acagaccauuucuuucuuu

SEQ ID NO: 5642 - RNA, 19 nt, Artificial Sequence
  Description of Artificial Sequence: Synthetic oligonucleotide
cagaccauuucuuucuuuc

SEQ ID NO: 5643 - RNA, 19 nt, Artificial Sequence
  Description of Artificial Sequence: Synthetic oligonucleotide
agaccauuucuuucuuucg

SEQ ID NO: 5644 - RNA, 19 nt, Artificial Sequence
  Description of Artificial Sequence: Synthetic oligonucleotide
gaccauuucuuucuuucgg

SEQ ID NO: 5645 - RNA, 19 nt, Artificial Sequence
  Description of Artificial Sequence: Synthetic oligonucleotide
accauuucuuucuuucggc

SEQ ID NO: 5646 - RNA, 19 nt, Artificial Sequence
  Description of Artificial Sequence: Synthetic oligonucleotide
ccauuucuuucuuucggcc

SEQ ID NO: 5647 - RNA, 19 nt, Artificial Sequence
  Description of Artificial Sequence: Synthetic oligonucleotide
cauuucuuucuuucggcca

SEQ ID NO: 5648 - RNA, 19 nt, Artificial Sequence
  Description of Artificial Sequence: Synthetic oligonucleotide
auuucuuucuuucggccag

SEQ ID NO: 5649 - RNA, 19 nt, Artificial Sequence
  Description of Artificial Sequence: Synthetic oligonucleotide
uuucuuucuuucggccagg

SEQ ID NO: 5650 - RNA, 19 nt, Artificial Sequence
  Description of Artificial Sequence: Synthetic oligonucleotide
uucuuucuuucggccaggc

SEQ ID NO: 5651 - RNA, 19 nt, Artificial Sequence
  Description of Artificial Sequence: Synthetic oligonucleotide
ucuuucuuucggccaggcu

SEQ ID NO: 5652 - RNA, 19 nt, Artificial Sequence
  Description of Artificial Sequence: Synthetic oligonucleotide
cuuucuuucggccaggcug

SEQ ID NO: 5653 - RNA, 19 nt, Artificial Sequence
  Description of Artificial Sequence: Synthetic oligonucleotide
uuucuuucggccaggcuga

SEQ ID NO: 5654 - RNA, 19 nt, Artificial Sequence
  Description of Artificial Sequence: Synthetic oligonucleotide
uucuuucggccaggcugag

SEQ ID NO: 5655 - RNA, 19 nt, Artificial Sequence
  Description of Artificial Sequence: Synthetic oligonucleotide
ucuuucggccaggcugagg

SEQ ID NO: 5656 - RNA, 19 nt, Artificial Sequence
  Description of Artificial Sequence: Synthetic oligonucleotide
cuuucggccaggcugaggc

SEQ ID NO: 5657 - RNA, 19 nt, Artificial Sequence
  Description of Artificial Sequence: Synthetic oligonucleotide
uuucggccaggcugaggcc

SEQ ID NO: 5658 - RNA, 19 nt, Artificial Sequence
  Description of Artificial Sequence: Synthetic oligonucleotide
uucggccaggcugaggccc

SEQ ID NO: 5659 - RNA, 19 nt, Artificial Sequence
  Description of Artificial Sequence: Synthetic oligonucleotide
ucggccaggcugaggcccu

SEQ ID NO: 5660 - RNA, 19 nt, Artificial Sequence
  Description of Artificial Sequence: Synthetic oligonucleotide
cggccaggcugaggcccug

SEQ ID NO: 5661 - RNA, 19 nt, Artificial Sequence
  Description of Artificial Sequence: Synthetic oligonucleotide
ggccaggcugaggcccuga

SEQ ID NO: 5662 - RNA, 19 nt, Artificial Sequence
  Description of Artificial Sequence: Synthetic oligonucleotide
gccaggcugaggcccugac

SEQ ID NO: 5663 - RNA, 19 nt, Artificial Sequence
  Description of Artificial Sequence: Synthetic oligonucleotide
ccaggcugaggcccugacg

SEQ ID NO: 5664 - RNA, 19 nt, Artificial Sequence
  Description of Artificial Sequence: Synthetic oligonucleotide
caggcugaggcccugacgu

SEQ ID NO: 5665 - RNA, 19 nt, Artificial Sequence
  Description of Artificial Sequence: Synthetic oligonucleotide
aggcugaggcccugacgug

SEQ ID NO: 5666 - RNA, 19 nt, Artificial Sequence
  Description of Artificial Sequence: Synthetic oligonucleotide
ggcugaggcccugacgugg

SEQ ID NO: 5667 - RNA, 19 nt, Artificial Sequence
  Description of Artificial Sequence: Synthetic oligonucleotide
gcugaggcccugacgugga

SEQ ID NO: 5668 - RNA, 19 nt, Artificial Sequence
  Description of Artificial Sequence: Synthetic oligonucleotide
cugaggcccugacguggau

SEQ ID NO: 5669 - RNA, 19 nt, Artificial Sequence
  Description of Artificial Sequence: Synthetic oligonucleotide
ugaggcccugacguggaug

SEQ ID NO: 5670 - RNA, 19 nt, Artificial Sequence
  Description of Artificial Sequence: Synthetic oligonucleotide
gaggcccugacguggaugg

SEQ ID NO: 5671 - RNA, 19 nt, Artificial Sequence
  Description of Artificial Sequence: Synthetic oligonucleotide
aggcccugacguggauggg

SEQ ID NO: 5672 - RNA, 19 nt, Artificial Sequence
  Description of Artificial Sequence: Synthetic oligonucleotide
ggcccugacguggaugggc

SEQ ID NO: 5673 - RNA, 19 nt, Artificial Sequence
  Description of Artificial Sequence: Synthetic oligonucleotide
gcccugacguggaugggca

SEQ ID NO: 5674 - RNA, 19 nt, Artificial Sequence
  Description of Artificial Sequence: Synthetic oligonucleotide
cccugacguggaugggcaa

SEQ ID NO: 5675 - RNA, 19 nt, Artificial Sequence
  Description of Artificial Sequence: Synthetic oligonucleotide
ccugacguggaugggcaaa

SEQ ID NO: 5676 - RNA, 19 nt, Artificial Sequence
  Description of Artificial Sequence: Synthetic oligonucleotide
cugacguggaugggcaaac

SEQ ID NO: 5677 - RNA, 19 nt, Artificial Sequence
  Description of Artificial Sequence: Synthetic oligonucleotide
ugacguggaugggcaaacu

SEQ ID NO: 5678 - RNA, 19 nt, Artificial Sequence
  Description of Artificial Sequence: Synthetic oligonucleotide
gacguggaugggcaaacug

SEQ ID NO: 5679 - RNA, 19 nt, Artificial Sequence
  Description of Artificial Sequence: Synthetic oligonucleotide
acguggaugggcaaacugc

SEQ ID NO: 5680 - RNA, 19 nt, Artificial Sequence
  Description of Artificial Sequence: Synthetic oligonucleotide
cguggaugggcaaacugca

SEQ ID NO: 5681 - RNA, 19 nt, Artificial Sequence
  Description of Artificial Sequence: Synthetic oligonucleotide
guggaugggcaaacugcag

SEQ ID NO: 5682 - RNA, 19 nt, Artificial Sequence
  Description of Artificial Sequence: Synthetic oligonucleotide
uggaugggcaaacugcagg

SEQ ID NO: 5683 - RNA, 19 nt, Artificial Sequence
  Description of Artificial Sequence: Synthetic oligonucleotide
ggaugggcaaacugcaggc

SEQ ID NO: 5684 - RNA, 19 nt, Artificial Sequence
  Description of Artificial Sequence: Synthetic oligonucleotide
gaugggcaaacugcaggcc

SEQ ID NO: 5685 - RNA, 19 nt, Artificial Sequence
  Description of Artificial Sequence: Synthetic oligonucleotide
augggcaaacugcaggccu

SEQ ID NO: 5686 - RNA, 19 nt, Artificial Sequence
  Description of Artificial Sequence: Synthetic oligonucleotide
ugggcaaacugcaggccug

SEQ ID NO: 5687 - RNA, 19 nt, Artificial Sequence
  Description of Artificial Sequence: Synthetic oligonucleotide
gggcaaacugcaggccugg

SEQ ID NO: 5688 - RNA, 19 nt, Artificial Sequence
  Description of Artificial Sequence: Synthetic oligonucleotide
ggcaaacugcaggccuggg

SEQ ID NO: 5689 - RNA, 19 nt, Artificial Sequence
  Description of Artificial Sequence: Synthetic oligonucleotide
gcaaacugcaggccuggga

SEQ ID NO: 5690 - RNA, 19 nt, Artificial Sequence
  Description of Artificial Sequence: Synthetic oligonucleotide
caaacugcaggccugggaa

SEQ ID NO: 5691 - RNA, 19 nt, Artificial Sequence
  Description of Artificial Sequence: Synthetic oligonucleotide
aaacugcaggccugggaag

SEQ ID NO: 5692 - RNA, 19 nt, Artificial Sequence
  Description of Artificial Sequence: Synthetic oligonucleotide
aacugcaggccugggaagg

SEQ ID NO: 5693 - RNA, 19 nt, Artificial Sequence
  Description of Artificial Sequence: Synthetic oligonucleotide
acugcaggccugggaaggc

SEQ ID NO: 5694 - RNA, 19 nt, Artificial Sequence
  Description of Artificial Sequence: Synthetic oligonucleotide
cugcaggccugggaaggca

SEQ ID NO: 5695 - RNA, 19 nt, Artificial Sequence
  Description of Artificial Sequence: Synthetic oligonucleotide
ugcaggccugggaaggcag

SEQ ID NO: 5696 - RNA, 19 nt, Artificial Sequence
  Description of Artificial Sequence: Synthetic oligonucleotide
gcaggccugggaaggcagc

SEQ ID NO: 5697 - RNA, 19 nt, Artificial Sequence
  Description of Artificial Sequence: Synthetic oligonucleotide
caggccugggaaggcagca

SEQ ID NO: 5698 - RNA, 19 nt, Artificial Sequence
  Description of Artificial Sequence: Synthetic oligonucleotide
aggccugggaaggcagcaa

SEQ ID NO: 5699 - RNA, 19 nt, Artificial Sequence
  Description of Artificial Sequence: Synthetic oligonucleotide
ggccugggaaggcagcaag

SEQ ID NO: 5700 - RNA, 19 nt, Artificial Sequence
  Description of Artificial Sequence: Synthetic oligonucleotide
gccugggaaggcagcaagc

SEQ ID NO: 5701 - RNA, 19 nt, Artificial Sequence
  Description of Artificial Sequence: Synthetic oligonucleotide
ccugggaaggcagcaagcc

SEQ ID NO: 5702 - RNA, 19 nt, Artificial Sequence
  Description of Artificial Sequence: Synthetic oligonucleotide
cugggaaggcagcaagccg

SEQ ID NO: 5703 - RNA, 19 nt, Artificial Sequence
  Description of Artificial Sequence: Synthetic oligonucleotide
ugggaaggcagcaagccgg

SEQ ID NO: 5704 - RNA, 19 nt, Artificial Sequence
  Description of Artificial Sequence: Synthetic oligonucleotide
gggaaggcagcaagccggg

SEQ ID NO: 5705 - RNA, 19 nt, Artificial Sequence
  Description of Artificial Sequence: Synthetic oligonucleotide
ggaaggcagcaagccgggc

SEQ ID NO: 5706 - RNA, 19 nt, Artificial Sequence
  Description of Artificial Sequence: Synthetic oligonucleotide
gaaggcagcaagccgggcc

SEQ ID NO: 5707 - RNA, 19 nt, Artificial Sequence
  Description of Artificial Sequence: Synthetic oligonucleotide
aaggcagcaagccgggccg

SEQ ID NO: 5708 - RNA, 19 nt, Artificial Sequence
  Description of Artificial Sequence: Synthetic oligonucleotide
aggcagcaagccgggccgu

SEQ ID NO: 5709 - RNA, 19 nt, Artificial Sequence
  Description of Artificial Sequence: Synthetic oligonucleotide
ggcagcaagccgggccguc

SEQ ID NO: 5710 - RNA, 19 nt, Artificial Sequence
  Description of Artificial Sequence: Synthetic oligonucleotide
gcagcaagccgggccgucc

SEQ ID NO: 5711 - RNA, 19 nt, Artificial Sequence
  Description of Artificial Sequence: Synthetic oligonucleotide
cagcaagccgggccguccg

SEQ ID NO: 5712 - RNA, 19 nt, Artificial Sequence
  Description of Artificial Sequence: Synthetic oligonucleotide
agcaagccgggccguccgu

SEQ ID NO: 5713 - RNA, 19 nt, Artificial Sequence
  Description of Artificial Sequence: Synthetic oligonucleotide
gcaagccgggccguccgug

SEQ ID NO: 5714 - RNA, 19 nt, Artificial Sequence
  Description of Artificial Sequence: Synthetic oligonucleotide
caagccgggccguccgugu

SEQ ID NO: 5715 - RNA, 19 nt, Artificial Sequence
  Description of Artificial Sequence: Synthetic oligonucleotide
aagccgggccguccguguu

SEQ ID NO: 5716 - RNA, 19 nt, Artificial Sequence
  Description of Artificial Sequence: Synthetic oligonucleotide
agccgggccguccguguuc

SEQ ID NO: 5717 - RNA, 19 nt, Artificial Sequence
  Description of Artificial Sequence: Synthetic oligonucleotide
gccgggccguccguguucc

SEQ ID NO: 5718 - RNA, 19 nt, Artificial Sequence
  Description of Artificial Sequence: Synthetic oligonucleotide
ccgggccguccguguucca

SEQ ID NO: 5719 - RNA, 19 nt, Artificial Sequence
  Description of Artificial Sequence: Synthetic oligonucleotide
cgggccguccguguuccau

SEQ ID NO: 5720 - RNA, 19 nt, Artificial Sequence
  Description of Artificial Sequence: Synthetic oligonucleotide
gggccguccguguuccauc

SEQ ID NO: 5721 - RNA, 19 nt, Artificial Sequence
  Description of Artificial Sequence: Synthetic oligonucleotide
ggccguccguguuccaucc

SEQ ID NO: 5722 - RNA, 19 nt, Artificial Sequence
  Description of Artificial Sequence: Synthetic oligonucleotide
gccguccguguuccauccu

SEQ ID NO: 5723 - RNA, 19 nt, Artificial Sequence
  Description of Artificial Sequence: Synthetic oligonucleotide
ccguccguguuccauccuc

SEQ ID NO: 5724 - RNA, 19 nt, Artificial Sequence
  Description of Artificial Sequence: Synthetic oligonucleotide
cguccguguuccauccucc

SEQ ID NO: 5725 - RNA, 19 nt, Artificial Sequence
  Description of Artificial Sequence: Synthetic oligonucleotide
guccguguuccauccucca

SEQ ID NO: 5726 - RNA, 19 nt, Artificial Sequence
  Description of Artificial Sequence: Synthetic oligonucleotide
uccguguuccauccuccac

SEQ ID NO: 5727 - RNA, 19 nt, Artificial Sequence
  Description of Artificial Sequence: Synthetic oligonucleotide
ccguguuccauccuccacg

SEQ ID NO: 5728 - RNA, 19 nt, Artificial Sequence
  Description of Artificial Sequence: Synthetic oligonucleotide
cguguuccauccuccacgc

SEQ ID NO: 5729 - RNA, 19 nt, Artificial Sequence
  Description of Artificial Sequence: Synthetic oligonucleotide
guguuccauccuccacgca

SEQ ID NO: 5730 - RNA, 19 nt, Artificial Sequence
  Description of Artificial Sequence: Synthetic oligonucleotide
uguuccauccuccacgcac

SEQ ID NO: 5731 - RNA, 19 nt, Artificial Sequence
  Description of Artificial Sequence: Synthetic oligonucleotide
guuccauccuccacgcacc

SEQ ID NO: 5732 - RNA, 19 nt, Artificial Sequence
  Description of Artificial Sequence: Synthetic oligonucleotide
uuccauccuccacgcaccc

SEQ ID NO: 5733 - RNA, 19 nt, Artificial Sequence
  Description of Artificial Sequence: Synthetic oligonucleotide
uccauccuccacgcacccc

SEQ ID NO: 5734 - RNA, 19 nt, Artificial Sequence
  Description of Artificial Sequence: Synthetic oligonucleotide
ccauccuccacgcaccccc

SEQ ID NO: 5735 - RNA, 19 nt, Artificial Sequence
  Description of Artificial Sequence: Synthetic oligonucleotide
cauccuccacgcaccccca

SEQ ID NO: 5736 - RNA, 19 nt, Artificial Sequence
  Description of Artificial Sequence: Synthetic oligonucleotide
auccuccacgcacccccac

SEQ ID NO: 5737 - RNA, 19 nt, Artificial Sequence
  Description of Artificial Sequence: Synthetic oligonucleotide
uccuccacgcacccccacc

SEQ ID NO: 5738 - RNA, 19 nt, Artificial Sequence
  Description of Artificial Sequence: Synthetic oligonucleotide
ccuccacgcacccccaccu

SEQ ID NO: 5739 - RNA, 19 nt, Artificial Sequence
  Description of Artificial Sequence: Synthetic oligonucleotide
cuccacgcacccccaccua

SEQ ID NO: 5740 - RNA, 19 nt, Artificial Sequence
  Description of Artificial Sequence: Synthetic oligonucleotide
uccacgcacccccaccuau

SEQ ID NO: 5741 - RNA, 19 nt, Artificial Sequence
  Description of Artificial Sequence: Synthetic oligonucleotide
ccacgcacccccaccuauc

SEQ ID NO: 5742 - RNA, 19 nt, Artificial Sequence
  Description of Artificial Sequence: Synthetic oligonucleotide
cacgcacccccaccuaucg

SEQ ID NO: 5743 - RNA, 19 nt, Artificial Sequence
  Description of Artificial Sequence: Synthetic oligonucleotide
acgcacccccaccuaucgu

SEQ ID NO: 5744 - RNA, 19 nt, Artificial Sequence
  Description of Artificial Sequence: Synthetic oligonucleotide
cgcacccccaccuaucguu

SEQ ID NO: 5745 - RNA, 19 nt, Artificial Sequence
  Description of Artificial Sequence: Synthetic oligonucleotide
gcacccccaccuaucguug

SEQ ID NO: 5746 - RNA, 19 nt, Artificial Sequence
  Description of Artificial Sequence: Synthetic oligonucleotide
cacccccaccuaucguugg

SEQ ID NO: 5747 - RNA, 19 nt, Artificial Sequence
  Description of Artificial Sequence: Synthetic oligonucleotide
acccccaccuaucguuggu

SEQ ID NO: 5748 - RNA, 19 nt, Artificial Sequence
  Description of Artificial Sequence: Synthetic oligonucleotide
cccccaccuaucguugguu

SEQ ID NO: 5749 - RNA, 19 nt, Artificial Sequence
  Description of Artificial Sequence: Synthetic oligonucleotide
ccccaccuaucguugguuc

SEQ ID NO: 5750 - RNA, 19 nt, Artificial Sequence
  Description of Artificial Sequence: Synthetic oligonucleotide
cccaccuaucguugguucg

SEQ ID NO: 5751 - RNA, 19 nt, Artificial Sequence
  Description of Artificial Sequence: Synthetic oligonucleotide
ccaccuaucguugguucgc

SEQ ID NO: 5752 - RNA, 19 nt, Artificial Sequence
  Description of Artificial Sequence: Synthetic oligonucleotide
caccuaucguugguucgca

SEQ ID NO: 5753 - RNA, 19 nt, Artificial Sequence
  Description of Artificial Sequence: Synthetic oligonucleotide
accuaucguugguucgcaa

SEQ ID NO: 5754 - RNA, 19 nt, Artificial Sequence
  Description of Artificial Sequence: Synthetic oligonucleotide
ccuaucguugguucgcaaa

SEQ ID NO: 5755 - RNA, 19 nt, Artificial Sequence
  Description of Artificial Sequence: Synthetic oligonucleotide
cuaucguugguucgcaaag

SEQ ID NO: 5756 - RNA, 19 nt, Artificial Sequence
  Description of Artificial Sequence: Synthetic oligonucleotide
uaucguugguucgcaaagu

SEQ ID NO: 5757 - RNA, 19 nt, Artificial Sequence
  Description of Artificial Sequence: Synthetic oligonucleotide
aucguugguucgcaaagug

SEQ ID NO: 5758 - RNA, 19 nt, Artificial Sequence
  Description of Artificial Sequence: Synthetic oligonucleotide
ucguugguucgcaaagugc

SEQ ID NO: 5759 - RNA, 19 nt, Artificial Sequence
  Description of Artificial Sequence: Synthetic oligonucleotide
cguugguucgcaaagugca

SEQ ID NO: 5760 - RNA, 19 nt, Artificial Sequence
  Description of Artificial Sequence: Synthetic oligonucleotide
guugguucgcaaagugcaa

SEQ ID NO: 5761 - RNA, 19 nt, Artificial Sequence
  Description of Artificial Sequence: Synthetic oligonucleotide
uugguucgcaaagugcaaa

SEQ ID NO: 5762 - RNA, 19 nt, Artificial Sequence
  Description of Artificial Sequence: Synthetic oligonucleotide
ugguucgcaaagugcaaag

SEQ ID NO: 5763 - RNA, 19 nt, Artificial Sequence
  Description of Artificial Sequence: Synthetic oligonucleotide
gguucgcaaagugcaaagc

SEQ ID NO: 5764 - RNA, 19 nt, Artificial Sequence
  Description of Artificial Sequence: Synthetic oligonucleotide
guucgcaaagugcaaagcu

SEQ ID NO: 5765 - RNA, 19 nt, Artificial Sequence
  Description of Artificial Sequence: Synthetic oligonucleotide
uucgcaaagugcaaagcuu

SEQ ID NO: 5766 - RNA, 19 nt, Artificial Sequence
  Description of Artificial Sequence: Synthetic oligonucleotide
ucgcaaagugcaaagcuuu

SEQ ID NO: 5767 - RNA, 19 nt, Artificial Sequence
  Description of Artificial Sequence: Synthetic oligonucleotide
cgcaaagugcaaagcuuuc

SEQ ID NO: 5768 - RNA, 19 nt, Artificial Sequence
  Description of Artificial Sequence: Synthetic oligonucleotide
gcaaagugcaaagcuuucu

SEQ ID NO: 5769 - RNA, 19 nt, Artificial Sequence
  Description of Artificial Sequence: Synthetic oligonucleotide
caaagugcaaagcuuucuu

SEQ ID NO: 5770 - RNA, 19 nt, Artificial Sequence
  Description of Artificial Sequence: Synthetic oligonucleotide
aaagugcaaagcuuucuug

SEQ ID NO: 5771 - RNA, 19 nt, Artificial Sequence
  Description of Artificial Sequence: Synthetic oligonucleotide
aagugcaaagcuuucuugu

SEQ ID NO: 5772 - RNA, 19 nt, Artificial Sequence
  Description of Artificial Sequence: Synthetic oligonucleotide
agugcaaagcuuucuugug

SEQ ID NO: 5773 - RNA, 19 nt, Artificial Sequence
  Description of Artificial Sequence: Synthetic oligonucleotide
gugcaaagcuuucuugugc

SEQ ID NO: 5774 - RNA, 19 nt, Artificial Sequence
  Description of Artificial Sequence: Synthetic oligonucleotide
ugcaaagcuuucuugugca

SEQ ID NO: 5775 - RNA, 19 nt, Artificial Sequence
  Description of Artificial Sequence: Synthetic oligonucleotide
gcaaagcuuucuugugcau

SEQ ID NO: 5776 - RNA, 19 nt, Artificial Sequence
  Description of Artificial Sequence: Synthetic oligonucleotide
caaagcuuucuugugcaug

SEQ ID NO: 5777 - RNA, 19 nt, Artificial Sequence
  Description of Artificial Sequence: Synthetic oligonucleotide
aaagcuuucuugugcauga

SEQ ID NO: 5778 - RNA, 19 nt, Artificial Sequence
  Description of Artificial Sequence: Synthetic oligonucleotide
aagcuuucuugugcaugac

SEQ ID NO: 5779 - RNA, 19 nt, Artificial Sequence
  Description of Artificial Sequence: Synthetic oligonucleotide
agcuuucuugugcaugacg

SEQ ID NO: 5780 - RNA, 19 nt, Artificial Sequence
  Description of Artificial Sequence: Synthetic oligonucleotide
gcuuucuugugcaugacgc

SEQ ID NO: 5781 - RNA, 19 nt, Artificial Sequence
  Description of Artificial Sequence: Synthetic oligonucleotide
cuuucuugugcaugacgcc

SEQ ID NO: 5782 - RNA, 19 nt, Artificial Sequence
  Description of Artificial Sequence: Synthetic oligonucleotide
uuucuugugcaugacgccc

SEQ ID NO: 5783 - RNA, 19 nt, Artificial Sequence
  Description of Artificial Sequence: Synthetic oligonucleotide
uucuugugcaugacgcccu

SEQ ID NO: 5784 - RNA, 19 nt, Artificial Sequence
  Description of Artificial Sequence: Synthetic oligonucleotide
ucuugugcaugacgcccug

SEQ ID NO: 5785 - RNA, 19 nt, Artificial Sequence
  Description of Artificial Sequence: Synthetic oligonucleotide
cuugugcaugacgcccugc

SEQ ID NO: 5786 - RNA, 19 nt, Artificial Sequence
  Description of Artificial Sequence: Synthetic oligonucleotide
uugugcaugacgcccugcu

SEQ ID NO: 5787 - RNA, 19 nt, Artificial Sequence
  Description of Artificial Sequence: Synthetic oligonucleotide
ugugcaugacgcccugcuc

SEQ ID NO: 5788 - RNA, 19 nt, Artificial Sequence
  Description of Artificial Sequence: Synthetic oligonucleotide
gugcaugacgcccugcucu

SEQ ID NO: 5789 - RNA, 19 nt, Artificial Sequence
  Description of Artificial Sequence: Synthetic oligonucleotide
ugcaugacgcccugcucug

SEQ ID NO: 5790 - RNA, 19 nt, Artificial Sequence
  Description of Artificial Sequence: Synthetic oligonucleotide
gcaugacgcccugcucugg

SEQ ID NO: 5791 - RNA, 19 nt, Artificial Sequence
  Description of Artificial Sequence: Synthetic oligonucleotide
caugacgcccugcucuggg

SEQ ID NO: 5792 - RNA, 19 nt, Artificial Sequence
  Description of Artificial Sequence: Synthetic oligonucleotide
augacgcccugcucugggg

SEQ ID NO: 5793 - RNA, 19 nt, Artificial Sequence
  Description of Artificial Sequence: Synthetic oligonucleotide
ugacgcccugcucugggga

SEQ ID NO: 5794 - RNA, 19 nt, Artificial Sequence
  Description of Artificial Sequence: Synthetic oligonucleotide
gacgcccugcucuggggag

SEQ ID NO: 5795 - RNA, 19 nt, Artificial Sequence
  Description of Artificial Sequence: Synthetic oligonucleotide
acgcccugcucuggggagc

SEQ ID NO: 5796 - RNA, 19 nt, Artificial Sequence
  Description of Artificial Sequence: Synthetic oligonucleotide
cgcccugcucuggggagcg

SEQ ID NO: 5797 - RNA, 19 nt, Artificial Sequence
  Description of Artificial Sequence: Synthetic oligonucleotide
gcccugcucuggggagcgu

SEQ ID NO: 5798 - RNA, 19 nt, Artificial Sequence
  Description of Artificial Sequence: Synthetic oligonucleotide
cccugcucuggggagcguc

SEQ ID NO: 5799 - RNA, 19 nt, Artificial Sequence
  Description of Artificial Sequence: Synthetic oligonucleotide
ccugcucuggggagcgucu

SEQ ID NO: 5800 - RNA, 19 nt, Artificial Sequence
  Description of Artificial Sequence: Synthetic oligonucleotide
cugcucuggggagcgucug

SEQ ID NO: 5801 - RNA, 19 nt, Artificial Sequence
  Description of Artificial Sequence: Synthetic oligonucleotide
ugcucuggggagcgucugg

SEQ ID NO: 5802 - RNA, 19 nt, Artificial Sequence
  Description of Artificial Sequence: Synthetic oligonucleotide
gcucuggggagcgucuggc

SEQ ID NO: 5803 - RNA, 19 nt, Artificial Sequence
  Description of Artificial Sequence: Synthetic oligonucleotide
cucuggggagcgucuggcg

SEQ ID NO: 5804 - RNA, 19 nt, Artificial Sequence
  Description of Artificial Sequence: Synthetic oligonucleotide
ucuggggagcgucuggcgc

SEQ ID NO: 5805 - RNA, 19 nt, Artificial Sequence
  Description of Artificial Sequence: Synthetic oligonucleotide
cuggggagcgucuggcgcg

SEQ ID NO: 5806 - RNA, 19 nt, Artificial Sequence
  Description of Artificial Sequence: Synthetic oligonucleotide
uggggagcgucuggcgcga

SEQ ID NO: 5807 - RNA, 19 nt, Artificial Sequence
  Description of Artificial Sequence: Synthetic oligonucleotide
ggggagcgucuggcgcgau

SEQ ID NO: 5808 - RNA, 19 nt, Artificial Sequence
  Description of Artificial Sequence: Synthetic oligonucleotide
gggagcgucuggcgcgauc

SEQ ID NO: 5809 - RNA, 19 nt, Artificial Sequence
  Description of Artificial Sequence: Synthetic oligonucleotide
ggagcgucuggcgcgaucu

SEQ ID NO: 5810 - RNA, 19 nt, Artificial Sequence
  Description of Artificial Sequence: Synthetic oligonucleotide
gagcgucuggcgcgaucuc

SEQ ID NO: 5811 - RNA, 19 nt, Artificial Sequence
  Description of Artificial Sequence: Synthetic oligonucleotide
agcgucuggcgcgaucucu

SEQ ID NO: 5812 - RNA, 19 nt, Artificial Sequence
  Description of Artificial Sequence: Synthetic oligonucleotide
gcgucuggcgcgaucucug

SEQ ID NO: 5813 - RNA, 19 nt, Artificial Sequence
  Description of Artificial Sequence: Synthetic oligonucleotide
cgucuggcgcgaucucugc

SEQ ID NO: 5814 - RNA, 19 nt, Artificial Sequence
  Description of Artificial Sequence: Synthetic oligonucleotide
gucuggcgcgaucucugcc

SEQ ID NO: 5815 - RNA, 19 nt, Artificial Sequence
  Description of Artificial Sequence: Synthetic oligonucleotide
ucuggcgcgaucucugccu

SEQ ID NO: 5816 - RNA, 19 nt, Artificial Sequence
  Description of Artificial Sequence: Synthetic oligonucleotide
cuggcgcgaucucugccug

SEQ ID NO: 5817 - RNA, 19 nt, Artificial Sequence
  Description of Artificial Sequence: Synthetic oligonucleotide
uggcgcgaucucugccugc

SEQ ID NO: 5818 - RNA, 19 nt, Artificial Sequence
  Description of Artificial Sequence: Synthetic oligonucleotide
ggcgcgaucucugccugcu

SEQ ID NO: 5819 - RNA, 19 nt, Artificial Sequence
  Description of Artificial Sequence: Synthetic oligonucleotide
gcgcgaucucugccugcuu

SEQ ID NO: 5820 - RNA, 19 nt, Artificial Sequence
  Description of Artificial Sequence: Synthetic oligonucleotide
cgcgaucucugccugcuua

SEQ ID NO: 5821 - RNA, 19 nt, Artificial Sequence
  Description of Artificial Sequence: Synthetic oligonucleotide
gcgaucucugccugcuuac

SEQ ID NO: 5822 - RNA, 19 nt, Artificial Sequence
  Description of Artificial Sequence: Synthetic oligonucleotide
cgaucucugccugcuuacu

SEQ ID NO: 5823 - RNA, 19 nt, Artificial Sequence
  Description of Artificial Sequence: Synthetic oligonucleotide
gaucucugccugcuuacuc

SEQ ID NO: 5824 - RNA, 19 nt, Artificial Sequence
  Description of Artificial Sequence: Synthetic oligonucleotide
aucucugccugcuuacucg

SEQ ID NO: 5825 - RNA, 19 nt, Artificial Sequence
  Description of Artificial Sequence: Synthetic oligonucleotide
ucucugccugcuuacucgg

SEQ ID NO: 5826 - RNA, 19 nt, Artificial Sequence
  Description of Artificial Sequence: Synthetic oligonucleotide
cucugccugcuuacucggg

SEQ ID NO: 5827 - RNA, 19 nt, Artificial Sequence
  Description of Artificial Sequence: Synthetic oligonucleotide
ucugccugcuuacucggga

SEQ ID NO: 5828 - RNA, 19 nt, Artificial Sequence
  Description of Artificial Sequence: Synthetic oligonucleotide
cugccugcuuacucgggaa

SEQ ID NO: 5829 - RNA, 19 nt, Artificial Sequence
  Description of Artificial Sequence: Synthetic oligonucleotide
ugccugcuuacucgggaaa

SEQ ID NO: 5830 - RNA, 19 nt, Artificial Sequence
  Description of Artificial Sequence: Synthetic oligonucleotide
gccugcuuacucgggaaau

SEQ ID NO: 5831 - RNA, 19 nt, Artificial Sequence
  Description of Artificial Sequence: Synthetic oligonucleotide
ccugcuuacucgggaaauu

SEQ ID NO: 5832 - RNA, 19 nt, Artificial Sequence
  Description of Artificial Sequence: Synthetic oligonucleotide
cugcuuacucgggaaauuu

SEQ ID NO: 5833 - RNA, 19 nt, Artificial Sequence
  Description of Artificial Sequence: Synthetic oligonucleotide
ugcuuacucgggaaauuug

SEQ ID NO: 5834 - RNA, 19 nt, Artificial Sequence
  Description of Artificial Sequence: Synthetic oligonucleotide
gcuuacucgggaaauuugc

SEQ ID NO: 5835 - RNA, 19 nt, Artificial Sequence
  Description of Artificial Sequence: Synthetic oligonucleotide
cuuacucgggaaauuugcu

SEQ ID NO: 5836 - RNA, 19 nt, Artificial Sequence
  Description of Artificial Sequence: Synthetic oligonucleotide
uuacucgggaaauuugcuu

SEQ ID NO: 5837 - RNA, 19 nt, Artificial Sequence
  Description of Artificial Sequence: Synthetic oligonucleotide
uacucgggaaauuugcuuu

SEQ ID NO: 5838 - RNA, 19 nt, Artificial Sequence
  Description of Artificial Sequence: Synthetic oligonucleotide
acucgggaaauuugcuuuu

SEQ ID NO: 5839 - RNA, 19 nt, Artificial Sequence
  Description of Artificial Sequence: Synthetic oligonucleotide
cucgggaaauuugcuuuug

SEQ ID NO: 5840 - RNA, 19 nt, Artificial Sequence
  Description of Artificial Sequence: Synthetic oligonucleotide
ucgggaaauuugcuuuugc

SEQ ID NO: 5841 - RNA, 19 nt, Artificial Sequence
  Description of Artificial Sequence: Synthetic oligonucleotide
cgggaaauuugcuuuugcc

SEQ ID NO: 5842 - RNA, 19 nt, Artificial Sequence
  Description of Artificial Sequence: Synthetic oligonucleotide
gggaaauuugcuuuugcca

SEQ ID NO: 5843 - RNA, 19 nt, Artificial Sequence
  Description of Artificial Sequence: Synthetic oligonucleotide
ggaaauuugcuuuugccaa

SEQ ID NO: 5844 - RNA, 19 nt, Artificial Sequence
  Description of Artificial Sequence: Synthetic oligonucleotide
gaaauuugcuuuugccaaa

SEQ ID NO: 5845 - RNA, 19 nt, Artificial Sequence
  Description of Artificial Sequence: Synthetic oligonucleotide
aaauuugcuuuugccaaac

SEQ ID NO: 5846 - RNA, 19 nt, Artificial Sequence
  Description of Artificial Sequence: Synthetic oligonucleotide
aauuugcuuuugccaaacc

SEQ ID NO: 5847 - RNA, 19 nt, Artificial Sequence
  Description of Artificial Sequence: Synthetic oligonucleotide
auuugcuuuugccaaaccc

SEQ ID NO: 5848 - RNA, 19 nt, Artificial Sequence
  Description of Artificial Sequence: Synthetic oligonucleotide
uuugcuuuugccaaacccg

SEQ ID NO: 5849 - RNA, 19 nt, Artificial Sequence
  Description of Artificial Sequence: Synthetic oligonucleotide
uugcuuuugccaaacccgc

SEQ ID NO: 5850 - RNA, 19 nt, Artificial Sequence
  Description of Artificial Sequence: Synthetic oligonucleotide
ugcuuuugccaaacccgcu

SEQ ID NO: 5851 - RNA, 19 nt, Artificial Sequence
  Description of Artificial Sequence: Synthetic oligonucleotide
gcuuuugccaaacccgcuu

SEQ ID NO: 5852 - RNA, 19 nt, Artificial Sequence
  Description of Artificial Sequence: Synthetic oligonucleotide
cuuuugccaaacccgcuuu

SEQ ID NO: 5853 - RNA, 19 nt, Artificial Sequence
  Description of Artificial Sequence: Synthetic oligonucleotide
uuuugccaaacccgcuuuu

SEQ ID NO: 5854 - RNA, 19 nt, Artificial Sequence
  Description of Artificial Sequence: Synthetic oligonucleotide
uuugccaaacccgcuuuuu

SEQ ID NO: 5855 - RNA, 19 nt, Artificial Sequence
  Description of Artificial Sequence: Synthetic oligonucleotide
uugccaaacccgcuuuuuc

SEQ ID NO: 5856 - RNA, 19 nt, Artificial Sequence
  Description of Artificial Sequence: Synthetic oligonucleotide
ugccaaacccgcuuuuucg

SEQ ID NO: 5857 - RNA, 19 nt, Artificial Sequence
  Description of Artificial Sequence: Synthetic oligonucleotide
gccaaacccgcuuuuucgg

SEQ ID NO: 5858 - RNA, 19 nt, Artificial Sequence
  Description of Artificial Sequence: Synthetic oligonucleotide
ccaaacccgcuuuuucggg

SEQ ID NO: 5859 - RNA, 19 nt, Artificial Sequence
  Description of Artificial Sequence: Synthetic oligonucleotide
caaacccgcuuuuucgggg

SEQ ID NO: 5860 - RNA, 19 nt, Artificial Sequence
  Description of Artificial Sequence: Synthetic oligonucleotide
aaacccgcuuuuucgggga

SEQ ID NO: 5861 - RNA, 19 nt, Artificial Sequence
  Description of Artificial Sequence: Synthetic oligonucleotide
aacccgcuuuuucggggau

SEQ ID NO: 5862 - RNA, 19 nt, Artificial Sequence
  Description of Artificial Sequence: Synthetic oligonucleotide
acccgcuuuuucggggauc

SEQ ID NO: 5863 - RNA, 19 nt, Artificial Sequence
  Description of Artificial Sequence: Synthetic oligonucleotide
cccgcuuuuucggggaucc

SEQ ID NO: 5864 - RNA, 19 nt, Artificial Sequence
  Description of Artificial Sequence: Synthetic oligonucleotide
ccgcuuuuucggggauccc

SEQ ID NO: 5865 - RNA, 19 nt, Artificial Sequence
  Description of Artificial Sequence: Synthetic oligonucleotide
cgcuuuuucggggaucccg

SEQ ID NO: 5866 - RNA, 19 nt, Artificial Sequence
  Description of Artificial Sequence: Synthetic oligonucleotide
gcuuuuucggggaucccgc

SEQ ID NO: 5867 - RNA, 19 nt, Artificial Sequence
  Description of Artificial Sequence: Synthetic oligonucleotide
cuuuuucggggaucccgcg

SEQ ID NO: 5868 - RNA, 19 nt, Artificial Sequence
  Description of Artificial Sequence: Synthetic oligonucleotide
uuuuucggggaucccgcgc

SEQ ID NO: 5869 - RNA, 19 nt, Artificial Sequence
  Description of Artificial Sequence: Synthetic oligonucleotide
uuuucggggaucccgcgcc

SEQ ID NO: 5870 - RNA, 19 nt, Artificial Sequence
  Description of Artificial Sequence: Synthetic oligonucleotide
uuucggggaucccgcgccc

SEQ ID NO: 5871 - RNA, 19 nt, Artificial Sequence
  Description of Artificial Sequence: Synthetic oligonucleotide
uucggggaucccgcgcccc

SEQ ID NO: 5872 - RNA, 19 nt, Artificial Sequence
  Description of Artificial Sequence: Synthetic oligonucleotide
ucggggaucccgcgccccc

SEQ ID NO: 5873 - RNA, 19 nt, Artificial Sequence
  Description of Artificial Sequence: Synthetic oligonucleotide
cggggaucccgcgcccccc

SEQ ID NO: 5874 - RNA, 19 nt, Artificial Sequence
  Description of Artificial Sequence: Synthetic oligonucleotide
ggggaucccgcgccccccu

SEQ ID NO: 5875 - RNA, 19 nt, Artificial Sequence
  Description of Artificial Sequence: Synthetic oligonucleotide
gggaucccgcgccccccuc

SEQ ID NO: 5876 - RNA, 19 nt, Artificial Sequence
  Description of Artificial Sequence: Synthetic oligonucleotide
ggaucccgcgccccccucc

SEQ ID NO: 5877 - RNA, 19 nt, Artificial Sequence
  Description of Artificial Sequence: Synthetic oligonucleotide
gaucccgcgccccccuccu

SEQ ID NO: 5878 - RNA, 19 nt, Artificial Sequence
  Description of Artificial Sequence: Synthetic oligonucleotide
aucccgcgccccccuccuc

SEQ ID NO: 5879 - RNA, 19 nt, Artificial Sequence
  Description of Artificial Sequence: Synthetic oligonucleotide
ucccgcgccccccuccuca

SEQ ID NO: 5880 - RNA, 19 nt, Artificial Sequence
  Description of Artificial Sequence: Synthetic oligonucleotide
cccgcgccccccuccucac

SEQ ID NO: 5881 - RNA, 19 nt, Artificial Sequence
  Description of Artificial Sequence: Synthetic oligonucleotide
ccgcgccccccuccucacu

SEQ ID NO: 5882 - RNA, 19 nt, Artificial Sequence
  Description of Artificial Sequence: Synthetic oligonucleotide
cgcgccccccuccucacuu

SEQ ID NO: 5883 - RNA, 19 nt, Artificial Sequence
  Description of Artificial Sequence: Synthetic oligonucleotide
gcgccccccuccucacuug

SEQ ID NO: 5884 - RNA, 19 nt, Artificial Sequence
  Description of Artificial Sequence: Synthetic oligonucleotide
cgccccccuccucacuugc

SEQ ID NO: 5885 - RNA, 19 nt, Artificial Sequence
  Description of Artificial Sequence: Synthetic oligonucleotide
gccccccuccucacuugcg

SEQ ID NO: 5886 - RNA, 19 nt, Artificial Sequence
  Description of Artificial Sequence: Synthetic oligonucleotide
ccccccuccucacuugcgc

SEQ ID NO: 5887 - RNA, 19 nt, Artificial Sequence
  Description of Artificial Sequence: Synthetic oligonucleotide
cccccuccucacuugcgcu

SEQ ID NO: 5888 - RNA, 19 nt, Artificial Sequence
  Description of Artificial Sequence: Synthetic oligonucleotide
ccccuccucacuugcgcug

SEQ ID NO: 5889 - RNA, 19 nt, Artificial Sequence
  Description of Artificial Sequence: Synthetic oligonucleotide
cccuccucacuugcgcugc

SEQ ID NO: 5890 - RNA, 19 nt, Artificial Sequence
  Description of Artificial Sequence: Synthetic oligonucleotide
ccuccucacuugcgcugcu

SEQ ID NO: 5891 - RNA, 19 nt, Artificial Sequence
  Description of Artificial Sequence: Synthetic oligonucleotide
cuccucacuugcgcugcuc

SEQ ID NO: 5892 - RNA, 19 nt, Artificial Sequence
  Description of Artificial Sequence: Synthetic oligonucleotide
uccucacuugcgcugcucu

SEQ ID NO: 5893 - RNA, 19 nt, Artificial Sequence
  Description of Artificial Sequence: Synthetic oligonucleotide
ccucacuugcgcugcucuc

SEQ ID NO: 5894 - RNA, 19 nt, Artificial Sequence
  Description of Artificial Sequence: Synthetic oligonucleotide
cucacuugcgcugcucucg

SEQ ID NO: 5895 - RNA, 19 nt, Artificial Sequence
  Description of Artificial Sequence: Synthetic oligonucleotide
ucacuugcgcugcucucgg

SEQ ID NO: 5896 - RNA, 19 nt, Artificial Sequence
  Description of Artificial Sequence: Synthetic oligonucleotide
cacuugcgcugcucucgga

SEQ ID NO: 5897 - RNA, 19 nt, Artificial Sequence
  Description of Artificial Sequence: Synthetic oligonucleotide
acuugcgcugcucucggag

SEQ ID NO: 5898 - RNA, 19 nt, Artificial Sequence
  Description of Artificial Sequence: Synthetic oligonucleotide
cuugcgcugcucucggagc

SEQ ID NO: 5899 - RNA, 19 nt, Artificial Sequence
  Description of Artificial Sequence: Synthetic oligonucleotide
uugcgcugcucucggagcc

SEQ ID NO: 5900 - RNA, 19 nt, Artificial Sequence
  Description of Artificial Sequence: Synthetic oligonucleotide
ugcgcugcucucggagccc

SEQ ID NO: 5901 - RNA, 19 nt, Artificial Sequence
  Description of Artificial Sequence: Synthetic oligonucleotide
gcgcugcucucggagcccc

SEQ ID NO: 5902 - RNA, 19 nt, Artificial Sequence
  Description of Artificial Sequence: Synthetic oligonucleotide
cgcugcucucggagcccca

SEQ ID NO: 5903 - RNA, 19 nt, Artificial Sequence
  Description of Artificial Sequence: Synthetic oligonucleotide
gcugcucucggagccccag

SEQ ID NO: 5904 - RNA, 19 nt, Artificial Sequence
  Description of Artificial Sequence: Synthetic oligonucleotide
cugcucucggagccccagc

SEQ ID NO: 5905 - RNA, 19 nt, Artificial Sequence
  Description of Artificial Sequence: Synthetic oligonucleotide
ugcucucggagccccagcc

SEQ ID NO: 5906 - RNA, 19 nt, Artificial Sequence
  Description of Artificial Sequence: Synthetic oligonucleotide
gcucucggagccccagccg

SEQ ID NO: 5907 - RNA, 19 nt, Artificial Sequence
  Description of Artificial Sequence: Synthetic oligonucleotide
cucucggagccccagccgg

SEQ ID NO: 5908 - RNA, 19 nt, Artificial Sequence
  Description of Artificial Sequence: Synthetic oligonucleotide
ucucggagccccagccggc

SEQ ID NO: 5909 - RNA, 19 nt, Artificial Sequence
  Description of Artificial Sequence: Synthetic oligonucleotide
cucggagccccagccggcu

SEQ ID NO: 5910 - RNA, 19 nt, Artificial Sequence
  Description of Artificial Sequence: Synthetic oligonucleotide
ucggagccccagccggcuc

SEQ ID NO: 5911 - RNA, 19 nt, Artificial Sequence
  Description of Artificial Sequence: Synthetic oligonucleotide
cggagccccagccggcucc

SEQ ID NO: 5912 - RNA, 19 nt, Artificial Sequence
  Description of Artificial Sequence: Synthetic oligonucleotide
ggagccccagccggcuccg

SEQ ID NO: 5913 - RNA, 19 nt, Artificial Sequence
  Description of Artificial Sequence: Synthetic oligonucleotide
gagccccagccggcuccgc

SEQ ID NO: 5914 - RNA, 19 nt, Artificial Sequence
  Description of Artificial Sequence: Synthetic oligonucleotide
agccccagccggcuccgcc

SEQ ID NO: 5915 - RNA, 19 nt, Artificial Sequence
  Description of Artificial Sequence: Synthetic oligonucleotide
gccccagccggcuccgccc

SEQ ID NO: 5916 - RNA, 19 nt, Artificial Sequence
  Description of Artificial Sequence: Synthetic oligonucleotide
ccccagccggcuccgcccg

SEQ ID NO: 5917 - RNA, 19 nt, Artificial Sequence
  Description of Artificial Sequence: Synthetic oligonucleotide
cccagccggcuccgcccgc

SEQ ID NO: 5918 - RNA, 19 nt, Artificial Sequence
  Description of Artificial Sequence: Synthetic oligonucleotide
ccagccggcuccgcccgcu

SEQ ID NO: 5919 - RNA, 19 nt, Artificial Sequence
  Description of Artificial Sequence: Synthetic oligonucleotide
cagccggcuccgcccgcuu

SEQ ID NO: 5920 - RNA, 19 nt, Artificial Sequence
  Description of Artificial Sequence: Synthetic oligonucleotide
agccggcuccgcccgcuuc

SEQ ID NO: 5921 - RNA, 19 nt, Artificial Sequence
  Description of Artificial Sequence: Synthetic oligonucleotide
gccggcuccgcccgcuucg

SEQ ID NO: 5922 - RNA, 19 nt, Artificial Sequence
  Description of Artificial Sequence: Synthetic oligonucleotide
ccggcuccgcccgcuucgg

SEQ ID NO: 5923 - RNA, 19 nt, Artificial Sequence
  Description of Artificial Sequence: Synthetic oligonucleotide
cggcuccgcccgcuucggc

SEQ ID NO: 5924 - RNA, 19 nt, Artificial Sequence
  Description of Artificial Sequence: Synthetic oligonucleotide
ggcuccgcccgcuucggcg

SEQ ID NO: 5925 - RNA, 19 nt, Artificial Sequence
  Description of Artificial Sequence: Synthetic oligonucleotide
gcuccgcccgcuucggcgg

SEQ ID NO: 5926 - RNA, 19 nt, Artificial Sequence
  Description of Artificial Sequence: Synthetic oligonucleotide
cuccgcccgcuucggcggu

SEQ ID NO: 5927 - RNA, 19 nt, Artificial Sequence
  Description of Artificial Sequence: Synthetic oligonucleotide
uccgcccgcuucggcgguu

SEQ ID NO: 5928 - RNA, 19 nt, Artificial Sequence
  Description of Artificial Sequence: Synthetic oligonucleotide
ccgcccgcuucggcgguuu

SEQ ID NO: 5929 - RNA, 19 nt, Artificial Sequence
  Description of Artificial Sequence: Synthetic oligonucleotide
cgcccgcuucggcgguuug

SEQ ID NO: 5930 - RNA, 19 nt, Artificial Sequence
  Description of Artificial Sequence: Synthetic oligonucleotide
gcccgcuucggcgguuugg

SEQ ID NO: 5931 - RNA, 19 nt, Artificial Sequence
  Description of Artificial Sequence: Synthetic oligonucleotide
cccgcuucggcgguuugga

SEQ ID NO: 5932 - RNA, 19 nt, Artificial Sequence
  Description of Artificial Sequence: Synthetic oligonucleotide
ccgcuucggcgguuuggau

SEQ ID NO: 5933 - RNA, 19 nt, Artificial Sequence
  Description of Artificial Sequence: Synthetic oligonucleotide
cgcuucggcgguuuggaua

SEQ ID NO: 5934 - RNA, 19 nt, Artificial Sequence
  Description of Artificial Sequence: Synthetic oligonucleotide
gcuucggcgguuuggauau

SEQ ID NO: 5935 - RNA, 19 nt, Artificial Sequence
  Description of Artificial Sequence: Synthetic oligonucleotide
cuucggcgguuuggauauu

SEQ ID NO: 5936 - RNA, 19 nt, Artificial Sequence
  Description of Artificial Sequence: Synthetic oligonucleotide
uucggcgguuuggauauuu

SEQ ID NO: 5937 - RNA, 19 nt, Artificial Sequence
  Description of Artificial Sequence: Synthetic oligonucleotide
ucggcgguuuggauauuua

SEQ ID NO: 5938 - RNA, 19 nt, Artificial Sequence
  Description of Artificial Sequence: Synthetic oligonucleotide
cggcgguuuggauauuuau

SEQ ID NO: 5939 - RNA, 19 nt, Artificial Sequence
  Description of Artificial Sequence: Synthetic oligonucleotide
ggcgguuuggauauuuauu

SEQ ID NO: 5940 - RNA, 19 nt, Artificial Sequence
  Description of Artificial Sequence: Synthetic oligonucleotide
gcgguuuggauauuuauug

SEQ ID NO: 5941 - RNA, 19 nt, Artificial Sequence
  Description of Artificial Sequence: Synthetic oligonucleotide
cgguuuggauauuuauuga

SEQ ID NO: 5942 - RNA, 19 nt, Artificial Sequence
  Description of Artificial Sequence: Synthetic oligonucleotide
gguuuggauauuuauugac

SEQ ID NO: 5943 - RNA, 19 nt, Artificial Sequence
  Description of Artificial Sequence: Synthetic oligonucleotide
guuuggauauuuauugacc

SEQ ID NO: 5944 - RNA, 19 nt, Artificial Sequence
  Description of Artificial Sequence: Synthetic oligonucleotide
uuuggauauuuauugaccu

SEQ ID NO: 5945 - RNA, 19 nt, Artificial Sequence
  Description of Artificial Sequence: Synthetic oligonucleotide
uuggauauuuauugaccuc

SEQ ID NO: 5946 - RNA, 19 nt, Artificial Sequence
  Description of Artificial Sequence: Synthetic oligonucleotide
uggauauuuauugaccucg

SEQ ID NO: 5947 - RNA, 19 nt, Artificial Sequence
  Description of Artificial Sequence: Synthetic oligonucleotide
ggauauuuauugaccucgu

SEQ ID NO: 5948 - RNA, 19 nt, Artificial Sequence
  Description of Artificial Sequence: Synthetic oligonucleotide
gauauuuauugaccucguc

SEQ ID NO: 5949 - RNA, 19 nt, Artificial Sequence
  Description of Artificial Sequence: Synthetic oligonucleotide
auauuuauugaccucgucc

SEQ ID NO: 5950 - RNA, 19 nt, Artificial Sequence
  Description of Artificial Sequence: Synthetic oligonucleotide
uauuuauugaccucguccu

SEQ ID NO: 5951 - RNA, 19 nt, Artificial Sequence
  Description of Artificial Sequence: Synthetic oligonucleotide
auuuauugaccucguccuc

SEQ ID NO: 5952 - RNA, 19 nt, Artificial Sequence
  Description of Artificial Sequence: Synthetic oligonucleotide
uuuauugaccucguccucc

SEQ ID NO: 5953 - RNA, 19 nt, Artificial Sequence
  Description of Artificial Sequence: Synthetic oligonucleotide
uuauugaccucguccuccg

SEQ ID NO: 5954 - RNA, 19 nt, Artificial Sequence
  Description of Artificial Sequence: Synthetic oligonucleotide
uauugaccucguccuccga

SEQ ID NO: 5955 - RNA, 19 nt, Artificial Sequence
  Description of Artificial Sequence: Synthetic oligonucleotide
auugaccucguccuccgac

SEQ ID NO: 5956 - RNA, 19 nt, Artificial Sequence
  Description of Artificial Sequence: Synthetic oligonucleotide
uugaccucguccuccgacu

SEQ ID NO: 5957 - RNA, 19 nt, Artificial Sequence
  Description of Artificial Sequence: Synthetic oligonucleotide
ugaccucguccuccgacuc

SEQ ID NO: 5958 - RNA, 19 nt, Artificial Sequence
  Description of Artificial Sequence: Synthetic oligonucleotide
gaccucguccuccgacucg

SEQ ID NO: 5959 - RNA, 19 nt, Artificial Sequence
  Description of Artificial Sequence: Synthetic oligonucleotide
accucguccuccgacucgc

SEQ ID NO: 5960 - RNA, 19 nt, Artificial Sequence
  Description of Artificial Sequence: Synthetic oligonucleotide
ccucguccuccgacucgcu

SEQ ID NO: 5961 - RNA, 19 nt, Artificial Sequence
  Description of Artificial Sequence: Synthetic oligonucleotide
cucguccuccgacucgcug

SEQ ID NO: 5962 - RNA, 19 nt, Artificial Sequence
  Description of Artificial Sequence: Synthetic oligonucleotide
ucguccuccgacucgcuga

SEQ ID NO: 5963 - RNA, 19 nt, Artificial Sequence
  Description of Artificial Sequence: Synthetic oligonucleotide
cguccuccgacucgcugac

SEQ ID NO: 5964 - RNA, 19 nt, Artificial Sequence
  Description of Artificial Sequence: Synthetic oligonucleotide
guccuccgacucgcugaca

SEQ ID NO: 5965 - RNA, 19 nt, Artificial Sequence
  Description of Artificial Sequence: Synthetic oligonucleotide
uccuccgacucgcugacag

SEQ ID NO: 5966 - RNA, 19 nt, Artificial Sequence
  Description of Artificial Sequence: Synthetic oligonucleotide
ccuccgacucgcugacagg

SEQ ID NO: 5967 - RNA, 19 nt, Artificial Sequence
  Description of Artificial Sequence: Synthetic oligonucleotide
cuccgacucgcugacaggc

SEQ ID NO: 5968 - RNA, 19 nt, Artificial Sequence
  Description of Artificial Sequence: Synthetic oligonucleotide
uccgacucgcugacaggcu

SEQ ID NO: 5969 - RNA, 19 nt, Artificial Sequence
  Description of Artificial Sequence: Synthetic oligonucleotide
ccgacucgcugacaggcua

SEQ ID NO: 5970 - RNA, 19 nt, Artificial Sequence
  Description of Artificial Sequence: Synthetic oligonucleotide
cgacucgcugacaggcuac

SEQ ID NO: 5971 - RNA, 19 nt, Artificial Sequence
  Description of Artificial Sequence: Synthetic oligonucleotide
gacucgcugacaggcuaca

SEQ ID NO: 5972 - RNA, 19 nt, Artificial Sequence
  Description of Artificial Sequence: Synthetic oligonucleotide
acucgcugacaggcuacag

SEQ ID NO: 5973 - RNA, 19 nt, Artificial Sequence
  Description of Artificial Sequence: Synthetic oligonucleotide
cucgcugacaggcuacagg

SEQ ID NO: 5974 - RNA, 19 nt, Artificial Sequence
  Description of Artificial Sequence: Synthetic oligonucleotide
ucgcugacaggcuacagga

SEQ ID NO: 5975 - RNA, 19 nt, Artificial Sequence
  Description of Artificial Sequence: Synthetic oligonucleotide
cgcugacaggcuacaggac

SEQ ID NO: 5976 - RNA, 19 nt, Artificial Sequence
  Description of Artificial Sequence: Synthetic oligonucleotide
gcugacaggcuacaggacc

SEQ ID NO: 5977 - RNA, 19 nt, Artificial Sequence
  Description of Artificial Sequence: Synthetic oligonucleotide
cugacaggcuacaggaccc

SEQ ID NO: 5978 - RNA, 19 nt, Artificial Sequence
  Description of Artificial Sequence: Synthetic oligonucleotide
ugacaggcuacaggacccc

SEQ ID NO: 5979 - RNA, 19 nt, Artificial Sequence
  Description of Artificial Sequence: Synthetic oligonucleotide
gacaggcuacaggaccccc

SEQ ID NO: 5980 - RNA, 19 nt, Artificial Sequence
  Description of Artificial Sequence: Synthetic oligonucleotide
acaggcuacaggaccccca

SEQ ID NO: 5981 - RNA, 19 nt, Artificial Sequence
  Description of Artificial Sequence: Synthetic oligonucleotide
caggcuacaggacccccaa

SEQ ID NO: 5982 - RNA, 19 nt, Artificial Sequence
  Description of Artificial Sequence: Synthetic oligonucleotide
aggcuacaggacccccaac

SEQ ID NO: 5983 - RNA, 19 nt, Artificial Sequence
  Description of Artificial Sequence: Synthetic oligonucleotide
ggcuacaggacccccaaca

SEQ ID NO: 5984 - RNA, 19 nt, Artificial Sequence
  Description of Artificial Sequence: Synthetic oligonucleotide
gcuacaggacccccaacaa

SEQ ID NO: 5985 - RNA, 19 nt, Artificial Sequence
  Description of Artificial Sequence: Synthetic oligonucleotide
cuacaggacccccaacaac

SEQ ID NO: 5986 - RNA, 19 nt, Artificial Sequence
  Description of Artificial Sequence: Synthetic oligonucleotide
uacaggacccccaacaacc

SEQ ID NO: 5987 - RNA, 19 nt, Artificial Sequence
  Description of Artificial Sequence: Synthetic oligonucleotide
acaggacccccaacaaccc

SEQ ID NO: 5988 - RNA, 19 nt, Artificial Sequence
  Description of Artificial Sequence: Synthetic oligonucleotide
caggacccccaacaacccc

SEQ ID NO: 5989 - RNA, 19 nt, Artificial Sequence
  Description of Artificial Sequence: Synthetic oligonucleotide
aggacccccaacaacccca

SEQ ID NO: 5990 - RNA, 19 nt, Artificial Sequence
  Description of Artificial Sequence: Synthetic oligonucleotide
ggacccccaacaaccccaa

SEQ ID NO: 5991 - RNA, 19 nt, Artificial Sequence
  Description of Artificial Sequence: Synthetic oligonucleotide
gacccccaacaaccccaau

SEQ ID NO: 5992 - RNA, 19 nt, Artificial Sequence
  Description of Artificial Sequence: Synthetic oligonucleotide
acccccaacaaccccaauc

SEQ ID NO: 5993 - RNA, 19 nt, Artificial Sequence
  Description of Artificial Sequence: Synthetic oligonucleotide
cccccaacaaccccaaucc

SEQ ID NO: 5994 - RNA, 19 nt, Artificial Sequence
  Description of Artificial Sequence: Synthetic oligonucleotide
ccccaacaaccccaaucca

SEQ ID NO: 5995 - RNA, 19 nt, Artificial Sequence
  Description of Artificial Sequence: Synthetic oligonucleotide
cccaacaaccccaauccac

SEQ ID NO: 5996 - RNA, 19 nt, Artificial Sequence
  Description of Artificial Sequence: Synthetic oligonucleotide
ccaacaaccccaauccacg

SEQ ID NO: 5997 - RNA, 19 nt, Artificial Sequence
  Description of Artificial Sequence: Synthetic oligonucleotide
caacaaccccaauccacgu

SEQ ID NO: 5998 - RNA, 19 nt, Artificial Sequence
  Description of Artificial Sequence: Synthetic oligonucleotide
aacaaccccaauccacguu

SEQ ID NO: 5999 - RNA, 19 nt, Artificial Sequence
  Description of Artificial Sequence: Synthetic oligonucleotide
acaaccccaauccacguuu

SEQ ID NO: 6000 - RNA, 19 nt, Artificial Sequence
  Description of Artificial Sequence: Synthetic oligonucleotide
caaccccaauccacguuuu

SEQ ID NO: 6001 - RNA, 19 nt, Artificial Sequence
  Description of Artificial Sequence: Synthetic oligonucleotide
aaccccaauccacguuuug

SEQ ID NO: 6002 - RNA, 19 nt, Artificial Sequence
  Description of Artificial Sequence: Synthetic oligonucleotide
accccaauccacguuuugg

SEQ ID NO: 6003 - RNA, 19 nt, Artificial Sequence
  Description of Artificial Sequence: Synthetic oligonucleotide
ccccaauccacguuuugga

SEQ ID NO: 6004 - RNA, 19 nt, Artificial Sequence
  Description of Artificial Sequence: Synthetic oligonucleotide
cccaauccacguuuuggau

SEQ ID NO: 6005 - RNA, 19 nt, Artificial Sequence
  Description of Artificial Sequence: Synthetic oligonucleotide
ccaauccacguuuuggaug

SEQ ID NO: 6006 - RNA, 19 nt, Artificial Sequence
  Description of Artificial Sequence: Synthetic oligonucleotide
caauccacguuuuggaugc

SEQ ID NO: 6007 - RNA, 19 nt, Artificial Sequence
  Description of Artificial Sequence: Synthetic oligonucleotide
aauccacguuuuggaugca

SEQ ID NO: 6008 - RNA, 19 nt, Artificial Sequence
  Description of Artificial Sequence: Synthetic oligonucleotide
auccacguuuuggaugcac

SEQ ID NO: 6009 - RNA, 19 nt, Artificial Sequence
  Description of Artificial Sequence: Synthetic oligonucleotide
uccacguuuuggaugcacu

SEQ ID NO: 6010 - RNA, 19 nt, Artificial Sequence
  Description of Artificial Sequence: Synthetic oligonucleotide
ccacguuuuggaugcacug

SEQ ID NO: 6011 - RNA, 19 nt, Artificial Sequence
  Description of Artificial Sequence: Synthetic oligonucleotide
cacguuuuggaugcacuga

SEQ ID NO: 6012 - RNA, 19 nt, Artificial Sequence
  Description of Artificial Sequence: Synthetic oligonucleotide
acguuuuggaugcacugag

SEQ ID NO: 6013 - RNA, 19 nt, Artificial Sequence
  Description of Artificial Sequence: Synthetic oligonucleotide
cguuuuggaugcacugaga

SEQ ID NO: 6014 - RNA, 19 nt, Artificial Sequence
  Description of Artificial Sequence: Synthetic oligonucleotide
guuuuggaugcacugagac

SEQ ID NO: 6015 - RNA, 19 nt, Artificial Sequence
  Description of Artificial Sequence: Synthetic oligonucleotide
uuuuggaugcacugagacc

SEQ ID NO: 6016 - RNA, 19 nt, Artificial Sequence
  Description of Artificial Sequence: Synthetic oligonucleotide
uuuggaugcacugagaccc

SEQ ID NO: 6017 - RNA, 19 nt, Artificial Sequence
  Description of Artificial Sequence: Synthetic oligonucleotide
uuggaugcacugagacccc

SEQ ID NO: 6018 - RNA, 19 nt, Artificial Sequence
  Description of Artificial Sequence: Synthetic oligonucleotide
uggaugcacugagaccccg

SEQ ID NO: 6019 - RNA, 19 nt, Artificial Sequence
  Description of Artificial Sequence: Synthetic oligonucleotide
ggaugcacugagaccccga

SEQ ID NO: 6020 - RNA, 19 nt, Artificial Sequence
  Description of Artificial Sequence: Synthetic oligonucleotide
gaugcacugagaccccgac

SEQ ID NO: 6021 - RNA, 19 nt, Artificial Sequence
  Description of Artificial Sequence: Synthetic oligonucleotide
augcacugagaccccgaca

SEQ ID NO: 6022 - RNA, 19 nt, Artificial Sequence
  Description of Artificial Sequence: Synthetic oligonucleotide
ugcacugagaccccgacau

SEQ ID NO: 6023 - RNA, 19 nt, Artificial Sequence
  Description of Artificial Sequence: Synthetic oligonucleotide
gcacugagaccccgacauu

SEQ ID NO: 6024 - RNA, 19 nt, Artificial Sequence
  Description of Artificial Sequence: Synthetic oligonucleotide
cacugagaccccgacauuc

SEQ ID NO: 6025 - RNA, 19 nt, Artificial Sequence
  Description of Artificial Sequence: Synthetic oligonucleotide
acugagaccccgacauucc

SEQ ID NO: 6026 - RNA, 19 nt, Artificial Sequence
  Description of Artificial Sequence: Synthetic oligonucleotide
cugagaccccgacauuccu

SEQ ID NO: 6027 - RNA, 19 nt, Artificial Sequence
  Description of Artificial Sequence: Synthetic oligonucleotide
ugagaccccgacauuccuc

SEQ ID NO: 6028 - RNA, 19 nt, Artificial Sequence
  Description of Artificial Sequence: Synthetic oligonucleotide
gagaccccgacauuccucg

SEQ ID NO: 6029 - RNA, 19 nt, Artificial Sequence
  Description of Artificial Sequence: Synthetic oligonucleotide
agaccccgacauuccucgg

SEQ ID NO: 6030 - RNA, 19 nt, Artificial Sequence
  Description of Artificial Sequence: Synthetic oligonucleotide
gaccccgacauuccucggu

SEQ ID NO: 6031 - RNA, 19 nt, Artificial Sequence
  Description of Artificial Sequence: Synthetic oligonucleotide
accccgacauuccucggua

SEQ ID NO: 6032 - RNA, 19 nt, Artificial Sequence
  Description of Artificial Sequence: Synthetic oligonucleotide
ccccgacauuccucgguau

SEQ ID NO: 6033 - RNA, 19 nt, Artificial Sequence
  Description of Artificial Sequence: Synthetic oligonucleotide
cccgacauuccucgguauu

SEQ ID NO: 6034 - RNA, 19 nt, Artificial Sequence
  Description of Artificial Sequence: Synthetic oligonucleotide
ccgacauuccucgguauuu

SEQ ID NO: 6035 - RNA, 19 nt, Artificial Sequence
  Description of Artificial Sequence: Synthetic oligonucleotide
cgacauuccucgguauuua

SEQ ID NO: 6036 - RNA, 19 nt, Artificial Sequence
  Description of Artificial Sequence: Synthetic oligonucleotide
gacauuccucgguauuuau

SEQ ID NO: 6037 - RNA, 19 nt, Artificial Sequence
  Description of Artificial Sequence: Synthetic oligonucleotide
acauuccucgguauuuauu

SEQ ID NO: 6038 - RNA, 19 nt, Artificial Sequence
  Description of Artificial Sequence: Synthetic oligonucleotide
cauuccucgguauuuauug

SEQ ID NO: 6039 - RNA, 19 nt, Artificial Sequence
  Description of Artificial Sequence: Synthetic oligonucleotide
auuccucgguauuuauugu

SEQ ID NO: 6040 - RNA, 19 nt, Artificial Sequence
  Description of Artificial Sequence: Synthetic oligonucleotide
uuccucgguauuuauuguc

SEQ ID NO: 6041 - RNA, 19 nt, Artificial Sequence
  Description of Artificial Sequence: Synthetic oligonucleotide
uccucgguauuuauugucu

SEQ ID NO: 6042 - RNA, 19 nt, Artificial Sequence
  Description of Artificial Sequence: Synthetic oligonucleotide
ccucgguauuuauugucug

SEQ ID NO: 6043 - RNA, 19 nt, Artificial Sequence
  Description of Artificial Sequence: Synthetic oligonucleotide
cucgguauuuauugucugu

SEQ ID NO: 6044 - RNA, 19 nt, Artificial Sequence
  Description of Artificial Sequence: Synthetic oligonucleotide
ucgguauuuauugucuguc

SEQ ID NO: 6045 - RNA, 19 nt, Artificial Sequence
  Description of Artificial Sequence: Synthetic oligonucleotide
cgguauuuauugucugucc

SEQ ID NO: 6046 - RNA, 19 nt, Artificial Sequence
  Description of Artificial Sequence: Synthetic oligonucleotide
gguauuuauugucuguccc

SEQ ID NO: 6047 - RNA, 19 nt, Artificial Sequence
  Description of Artificial Sequence: Synthetic oligonucleotide
guauuuauugucugucccc

SEQ ID NO: 6048 - RNA, 19 nt, Artificial Sequence
  Description of Artificial Sequence: Synthetic oligonucleotide
uauuuauugucugucccca

SEQ ID NO: 6049 - RNA, 19 nt, Artificial Sequence
  Description of Artificial Sequence: Synthetic oligonucleotide
auuuauugucuguccccac

SEQ ID NO: 6050 - RNA, 19 nt, Artificial Sequence
  Description of Artificial Sequence: Synthetic oligonucleotide
uuuauugucuguccccacc

SEQ ID NO: 6051 - RNA, 19 nt, Artificial Sequence
  Description of Artificial Sequence: Synthetic oligonucleotide
uuauugucuguccccaccu

SEQ ID NO: 6052 - RNA, 19 nt, Artificial Sequence
  Description of Artificial Sequence: Synthetic oligonucleotide
uauugucuguccccaccua

SEQ ID NO: 6053 - RNA, 19 nt, Artificial Sequence
  Description of Artificial Sequence: Synthetic oligonucleotide
auugucuguccccaccuag

SEQ ID NO: 6054 - RNA, 19 nt, Artificial Sequence
  Description of Artificial Sequence: Synthetic oligonucleotide
uugucuguccccaccuagg

SEQ ID NO: 6055 - RNA, 19 nt, Artificial Sequence
  Description of Artificial Sequence: Synthetic oligonucleotide
ugucuguccccaccuagga

SEQ ID NO: 6056 - RNA, 19 nt, Artificial Sequence
  Description of Artificial Sequence: Synthetic oligonucleotide
gucuguccccaccuaggac

SEQ ID NO: 6057 - RNA, 19 nt, Artificial Sequence
  Description of Artificial Sequence: Synthetic oligonucleotide
ucuguccccaccuaggacc

SEQ ID NO: 6058 - RNA, 19 nt, Artificial Sequence
  Description of Artificial Sequence: Synthetic oligonucleotide
cuguccccaccuaggaccc

SEQ ID NO: 6059 - RNA, 19 nt, Artificial Sequence
  Description of Artificial Sequence: Synthetic oligonucleotide
uguccccaccuaggacccc

SEQ ID NO: 6060 - RNA, 19 nt, Artificial Sequence
  Description of Artificial Sequence: Synthetic oligonucleotide
guccccaccuaggaccccc

SEQ ID NO: 6061 - RNA, 19 nt, Artificial Sequence
  Description of Artificial Sequence: Synthetic oligonucleotide
uccccaccuaggaccccca

SEQ ID NO: 6062 - RNA, 19 nt, Artificial Sequence
  Description of Artificial Sequence: Synthetic oligonucleotide
ccccaccuaggacccccac

SEQ ID NO: 6063 - RNA, 19 nt, Artificial Sequence
  Description of Artificial Sequence: Synthetic oligonucleotide
cccaccuaggacccccacc

SEQ ID NO: 6064 - RNA, 19 nt, Artificial Sequence
  Description of Artificial Sequence: Synthetic oligonucleotide
ccaccuaggacccccaccc

SEQ ID NO: 6065 - RNA, 19 nt, Artificial Sequence
  Description of Artificial Sequence: Synthetic oligonucleotide
caccuaggacccccacccc

SEQ ID NO: 6066 - RNA, 19 nt, Artificial Sequence
  Description of Artificial Sequence: Synthetic oligonucleotide
accuaggacccccaccccc

SEQ ID NO: 6067 - RNA, 19 nt, Artificial Sequence
  Description of Artificial Sequence: Synthetic oligonucleotide
ccuaggacccccacccccg

SEQ ID NO: 6068 - RNA, 19 nt, Artificial Sequence
  Description of Artificial Sequence: Synthetic oligonucleotide
cuaggacccccacccccga

SEQ ID NO: 6069 - RNA, 19 nt, Artificial Sequence
  Description of Artificial Sequence: Synthetic oligonucleotide
uaggacccccacccccgac

SEQ ID NO: 6070 - RNA, 19 nt, Artificial Sequence
  Description of Artificial Sequence: Synthetic oligonucleotide
aggacccccacccccgacc

SEQ ID NO: 6071 - RNA, 19 nt, Artificial Sequence
  Description of Artificial Sequence: Synthetic oligonucleotide
ggacccccacccccgaccc

SEQ ID NO: 6072 - RNA, 19 nt, Artificial Sequence
  Description of Artificial Sequence: Synthetic oligonucleotide
gacccccacccccgacccu

SEQ ID NO: 6073 - RNA, 19 nt, Artificial Sequence
  Description of Artificial Sequence: Synthetic oligonucleotide
acccccacccccgacccuc

SEQ ID NO: 6074 - RNA, 19 nt, Artificial Sequence
  Description of Artificial Sequence: Synthetic oligonucleotide
cccccacccccgacccucg

SEQ ID NO: 6075 - RNA, 19 nt, Artificial Sequence
  Description of Artificial Sequence: Synthetic oligonucleotide
ccccacccccgacccucgc

SEQ ID NO: 6076 - RNA, 19 nt, Artificial Sequence
  Description of Artificial Sequence: Synthetic oligonucleotide
cccacccccgacccucgcg

SEQ ID NO: 6077 - RNA, 19 nt, Artificial Sequence
  Description of Artificial Sequence: Synthetic oligonucleotide
ccacccccgacccucgcga

SEQ ID NO: 6078 - RNA, 19 nt, Artificial Sequence
  Description of Artificial Sequence: Synthetic oligonucleotide
cacccccgacccucgcgaa

SEQ ID NO: 6079 - RNA, 19 nt, Artificial Sequence
  Description of Artificial Sequence: Synthetic oligonucleotide
acccccgacccucgcgaau

SEQ ID NO: 6080 - RNA, 19 nt, Artificial Sequence
  Description of Artificial Sequence: Synthetic oligonucleotide
cccccgacccucgcgaaua

SEQ ID NO: 6081 - RNA, 19 nt, Artificial Sequence
  Description of Artificial Sequence: Synthetic oligonucleotide
ccccgacccucgcgaauaa

SEQ ID NO: 6082 - RNA, 19 nt, Artificial Sequence
  Description of Artificial Sequence: Synthetic oligonucleotide
cccgacccucgcgaauaaa

SEQ ID NO: 6083 - RNA, 19 nt, Artificial Sequence
  Description of Artificial Sequence: Synthetic oligonucleotide
ccgacccucgcgaauaaaa

SEQ ID NO: 6084 - RNA, 19 nt, Artificial Sequence
  Description of Artificial Sequence: Synthetic oligonucleotide
cgacccucgcgaauaaaag

SEQ ID NO: 6085 - RNA, 19 nt, Artificial Sequence
  Description of Artificial Sequence: Synthetic oligonucleotide
gacccucgcgaauaaaagg

SEQ ID NO: 6086 - RNA, 19 nt, Artificial Sequence
  Description of Artificial Sequence: Synthetic oligonucleotide
acccucgcgaauaaaaggc

SEQ ID NO: 6087 - RNA, 19 nt, Artificial Sequence
  Description of Artificial Sequence: Synthetic oligonucleotide
cccucgcgaauaaaaggcc

SEQ ID NO: 6088 - RNA, 19 nt, Artificial Sequence
  Description of Artificial Sequence: Synthetic oligonucleotide
ccucgcgaauaaaaggccc

SEQ ID NO: 6089 - RNA, 19 nt, Artificial Sequence
  Description of Artificial Sequence: Synthetic oligonucleotide
cucgcgaauaaaaggcccu

SEQ ID NO: 6090 - RNA, 19 nt, Artificial Sequence
  Description of Artificial Sequence: Synthetic oligonucleotide
ucgcgaauaaaaggcccuc

SEQ ID NO: 6091 - RNA, 19 nt, Artificial Sequence
  Description of Artificial Sequence: Synthetic oligonucleotide
cgcgaauaaaaggcccucc

SEQ ID NO: 6092 - RNA, 19 nt, Artificial Sequence
  Description of Artificial Sequence: Synthetic oligonucleotide
gcgaauaaaaggcccucca

SEQ ID NO: 6093 - RNA, 19 nt, Artificial Sequence
  Description of Artificial Sequence: Synthetic oligonucleotide
cgaauaaaaggcccuccau

SEQ ID NO: 6094 - RNA, 19 nt, Artificial Sequence
  Description of Artificial Sequence: Synthetic oligonucleotide
gaauaaaaggcccuccauc

SEQ ID NO: 6095 - RNA, 19 nt, Artificial Sequence
  Description of Artificial Sequence: Synthetic oligonucleotide
aauaaaaggcccuccaucu

SEQ ID NO: 6096 - RNA, 19 nt, Artificial Sequence
  Description of Artificial Sequence: Synthetic oligonucleotide
auaaaaggcccuccaucug

SEQ ID NO: 6097 - RNA, 19 nt, Artificial Sequence
  Description of Artificial Sequence: Synthetic oligonucleotide
uaaaaggcccuccaucugc

SEQ ID NO: 6098 - RNA, 19 nt, Artificial Sequence
  Description of Artificial Sequence: Synthetic oligonucleotide
aaaaggcccuccaucugcc

SEQ ID NO: 6099 - RNA, 19 nt, Artificial Sequence
  Description of Artificial Sequence: Synthetic oligonucleotide
aaaggcccuccaucugccc

SEQ ID NO: 6100 - RNA, 19 nt, Artificial Sequence
  Description of Artificial Sequence: Synthetic oligonucleotide
aaggcccuccaucugccca

SEQ ID NO: 6101 - RNA, 19 nt, Artificial Sequence
  Description of Artificial Sequence: Synthetic oligonucleotide
aggcccuccaucugcccaa

SEQ ID NO: 6102 - RNA, 19 nt, Artificial Sequence
  Description of Artificial Sequence: Synthetic oligonucleotide
ggcccuccaucugcccaaa

SEQ ID NO: 6103 - RNA, 19 nt, Artificial Sequence
  Description of Artificial Sequence: Synthetic oligonucleotide
gcccuccaucugcccaaag

SEQ ID NO: 6104 - RNA, 19 nt, Artificial Sequence
  Description of Artificial Sequence: Synthetic oligonucleotide
cccuccaucugcccaaagc

SEQ ID NO: 6105 - RNA, 19 nt, Artificial Sequence
  Description of Artificial Sequence: Synthetic oligonucleotide
ccuccaucugcccaaagcu

SEQ ID NO: 6106 - RNA, 19 nt, Artificial Sequence
  Description of Artificial Sequence: Synthetic oligonucleotide
cuccaucugcccaaagcuc

SEQ ID NO: 6107 - RNA, 19 nt, Artificial Sequence
  Description of Artificial Sequence: Synthetic oligonucleotide
uccaucugcccaaagcucu

SEQ ID NO: 6108 - RNA, 19 nt, Artificial Sequence
  Description of Artificial Sequence: Synthetic oligonucleotide
ccaucugcccaaagcucug

SEQ ID NO: 6109 - RNA, 19 nt, Artificial Sequence
  Description of Artificial Sequence: Synthetic oligonucleotide
caucugcccaaagcucugg

SEQ ID NO: 6110 - RNA, 19 nt, Artificial Sequence
  Description of Artificial Sequence: Synthetic oligonucleotide
aucugcccaaagcucugga

SEQ ID NO: 6111 - RNA, 19 nt, Artificial Sequence
  Description of Artificial Sequence: Synthetic oligonucleotide
cccuugguccagccccccu

SEQ ID NO: 6112 - RNA, 19 nt, Artificial Sequence
  Description of Artificial Sequence: Synthetic oligonucleotide
ccccuugguccagcccccc

SEQ ID NO: 6113 - RNA, 19 nt, Artificial Sequence
  Description of Artificial Sequence: Synthetic oligonucleotide
accccuugguccagccccc

SEQ ID NO: 6114 - RNA, 19 nt, Artificial Sequence
  Description of Artificial Sequence: Synthetic oligonucleotide
caccccuugguccagcccc

SEQ ID NO: 6115 - RNA, 19 nt, Artificial Sequence
  Description of Artificial Sequence: Synthetic oligonucleotide
ccaccccuugguccagccc

SEQ ID NO: 6116 - RNA, 19 nt, Artificial Sequence
  Description of Artificial Sequence: Synthetic oligonucleotide
cccaccccuugguccagcc

SEQ ID NO: 6117 - RNA, 19 nt, Artificial Sequence
  Description of Artificial Sequence: Synthetic oligonucleotide
ccccaccccuugguccagc

SEQ ID NO: 6118 - RNA, 19 nt, Artificial Sequence
  Description of Artificial Sequence: Synthetic oligonucleotide
uccccaccccuugguccag

SEQ ID NO: 6119 - RNA, 19 nt, Artificial Sequence
  Description of Artificial Sequence: Synthetic oligonucleotide
cuccccaccccuuggucca

SEQ ID NO: 6120 - RNA, 19 nt, Artificial Sequence
  Description of Artificial Sequence: Synthetic oligonucleotide
ucuccccaccccuuggucc

SEQ ID NO: 6121 - RNA, 19 nt, Artificial Sequence
  Description of Artificial Sequence: Synthetic oligonucleotide
uucuccccaccccuugguc

SEQ ID NO: 6122 - RNA, 19 nt, Artificial Sequence
  Description of Artificial Sequence: Synthetic oligonucleotide
cuucuccccaccccuuggu

SEQ ID NO: 6123 - RNA, 19 nt, Artificial Sequence
  Description of Artificial Sequence: Synthetic oligonucleotide
ccuucuccccaccccuugg

SEQ ID NO: 6124 - RNA, 19 nt, Artificial Sequence
  Description of Artificial Sequence: Synthetic oligonucleotide
cccuucuccccaccccuug

SEQ ID NO: 6125 - RNA, 19 nt, Artificial Sequence
  Description of Artificial Sequence: Synthetic oligonucleotide
ccccuucuccccaccccuu

SEQ ID NO: 6126 - RNA, 19 nt, Artificial Sequence
  Description of Artificial Sequence: Synthetic oligonucleotide
uccccuucuccccaccccu

SEQ ID NO: 6127 - RNA, 19 nt, Artificial Sequence
  Description of Artificial Sequence: Synthetic oligonucleotide
cuccccuucuccccacccc

SEQ ID NO: 6128 - RNA, 19 nt, Artificial Sequence
  Description of Artificial Sequence: Synthetic oligonucleotide
ccuccccuucuccccaccc

SEQ ID NO: 6129 - RNA, 19 nt, Artificial Sequence
  Description of Artificial Sequence: Synthetic oligonucleotide
uccuccccuucuccccacc

SEQ ID NO: 6130 - RNA, 19 nt, Artificial Sequence
  Description of Artificial Sequence: Synthetic oligonucleotide
cuccuccccuucuccccac

SEQ ID NO: 6131 - RNA, 19 nt, Artificial Sequence
  Description of Artificial Sequence: Synthetic oligonucleotide
ccuccuccccuucucccca

SEQ ID NO: 6132 - RNA, 19 nt, Artificial Sequence
  Description of Artificial Sequence: Synthetic oligonucleotide
gccuccuccccuucucccc

SEQ ID NO: 6133 - RNA, 19 nt, Artificial Sequence
  Description of Artificial Sequence: Synthetic oligonucleotide
ggccuccuccccuucuccc

SEQ ID NO: 6134 - RNA, 19 nt, Artificial Sequence
  Description of Artificial Sequence: Synthetic oligonucleotide
aggccuccuccccuucucc

SEQ ID NO: 6135 - RNA, 19 nt, Artificial Sequence
  Description of Artificial Sequence: Synthetic oligonucleotide
gaggccuccuccccuucuc

SEQ ID NO: 6136 - RNA, 19 nt, Artificial Sequence
  Description of Artificial Sequence: Synthetic oligonucleotide
cgaggccuccuccccuucu

SEQ ID NO: 6137 - RNA, 19 nt, Artificial Sequence
  Description of Artificial Sequence: Synthetic oligonucleotide
ccgaggccuccuccccuuc

SEQ ID NO: 6138 - RNA, 19 nt, Artificial Sequence
  Description of Artificial Sequence: Synthetic oligonucleotide
gccgaggccuccuccccuu

SEQ ID NO: 6139 - RNA, 19 nt, Artificial Sequence
  Description of Artificial Sequence: Synthetic oligonucleotide
ggccgaggccuccuccccu

SEQ ID NO: 6140 - RNA, 19 nt, Artificial Sequence
  Description of Artificial Sequence: Synthetic oligonucleotide
cggccgaggccuccucccc

SEQ ID NO: 6141 - RNA, 19 nt, Artificial Sequence
  Description of Artificial Sequence: Synthetic oligonucleotide
ccggccgaggccuccuccc

SEQ ID NO: 6142 - RNA, 19 nt, Artificial Sequence
  Description of Artificial Sequence: Synthetic oligonucleotide
gccggccgaggccuccucc

SEQ ID NO: 6143 - RNA, 19 nt, Artificial Sequence
  Description of Artificial Sequence: Synthetic oligonucleotide
ggccggccgaggccuccuc

SEQ ID NO: 6144 - RNA, 19 nt, Artificial Sequence
  Description of Artificial Sequence: Synthetic oligonucleotide
cggccggccgaggccuccu

SEQ ID NO: 6145 - RNA, 19 nt, Artificial Sequence
  Description of Artificial Sequence: Synthetic oligonucleotide
gcggccggccgaggccucc

SEQ ID NO: 6146 - RNA, 19 nt, Artificial Sequence
  Description of Artificial Sequence: Synthetic oligonucleotide
ugcggccggccgaggccuc

SEQ ID NO: 6147 - RNA, 19 nt, Artificial Sequence
  Description of Artificial Sequence: Synthetic oligonucleotide
cugcggccggccgaggccu

SEQ ID NO: 6148 - RNA, 19 nt, Artificial Sequence
  Description of Artificial Sequence: Synthetic oligonucleotide
ucugcggccggccgaggcc

SEQ ID NO: 6149 - RNA, 19 nt, Artificial Sequence
  Description of Artificial Sequence: Synthetic oligonucleotide
cucugcggccggccgaggc

SEQ ID NO: 6150 - RNA, 19 nt, Artificial Sequence
  Description of Artificial Sequence: Synthetic oligonucleotide
ucucugcggccggccgagg

SEQ ID NO: 6151 - RNA, 19 nt, Artificial Sequence
  Description of Artificial Sequence: Synthetic oligonucleotide
cucucugcggccggccgag

SEQ ID NO: 6152 - RNA, 19 nt, Artificial Sequence
  Description of Artificial Sequence: Synthetic oligonucleotide
ucucucugcggccggccga

SEQ ID NO: 6153 - RNA, 19 nt, Artificial Sequence
  Description of Artificial Sequence: Synthetic oligonucleotide
uucucucugcggccggccg

SEQ ID NO: 6154 - RNA, 19 nt, Artificial Sequence
  Description of Artificial Sequence: Synthetic oligonucleotide
cuucucucugcggccggcc

SEQ ID NO: 6155 - RNA, 19 nt, Artificial Sequence
  Description of Artificial Sequence: Synthetic oligonucleotide
acuucucucugcggccggc

SEQ ID NO: 6156 - RNA, 19 nt, Artificial Sequence
  Description of Artificial Sequence: Synthetic oligonucleotide
cacuucucucugcggccgg

SEQ ID NO: 6157 - RNA, 19 nt, Artificial Sequence
  Description of Artificial Sequence: Synthetic oligonucleotide
ccacuucucucugcggccg

SEQ ID NO: 6158 - RNA, 19 nt, Artificial Sequence
  Description of Artificial Sequence: Synthetic oligonucleotide
gccacuucucucugcggcc

SEQ ID NO: 6159 - RNA, 19 nt, Artificial Sequence
  Description of Artificial Sequence: Synthetic oligonucleotide
ggccacuucucucugcggc

SEQ ID NO: 6160 - RNA, 19 nt, Artificial Sequence
  Description of Artificial Sequence: Synthetic oligonucleotide
uggccacuucucucugcgg

SEQ ID NO: 6161 - RNA, 19 nt, Artificial Sequence
  Description of Artificial Sequence: Synthetic oligonucleotide
cuggccacuucucucugcg

SEQ ID NO: 6162 - RNA, 19 nt, Artificial Sequence
  Description of Artificial Sequence: Synthetic oligonucleotide
ucuggccacuucucucugc

SEQ ID NO: 6163 - RNA, 19 nt, Artificial Sequence
  Description of Artificial Sequence: Synthetic oligonucleotide
cucuggccacuucucucug

SEQ ID NO: 6164 - RNA, 19 nt, Artificial Sequence
  Description of Artificial Sequence: Synthetic oligonucleotide
ucucuggccacuucucucu

SEQ ID NO: 6165 - RNA, 19 nt, Artificial Sequence
  Description of Artificial Sequence: Synthetic oligonucleotide
cucucuggccacuucucuc

SEQ ID NO: 6166 - RNA, 19 nt, Artificial Sequence
  Description of Artificial Sequence: Synthetic oligonucleotide
ccucucuggccacuucucu

SEQ ID NO: 6167 - RNA, 19 nt, Artificial Sequence
  Description of Artificial Sequence: Synthetic oligonucleotide
gccucucuggccacuucuc

SEQ ID NO: 6168 - RNA, 19 nt, Artificial Sequence
  Description of Artificial Sequence: Synthetic oligonucleotide
ggccucucuggccacuucu

SEQ ID NO: 6169 - RNA, 19 nt, Artificial Sequence
  Description of Artificial Sequence: Synthetic oligonucleotide
gggccucucuggccacuuc

SEQ ID NO: 6170 - RNA, 19 nt, Artificial Sequence
  Description of Artificial Sequence: Synthetic oligonucleotide
ugggccucucuggccacuu

SEQ ID NO: 6171 - RNA, 19 nt, Artificial Sequence
  Description of Artificial Sequence: Synthetic oligonucleotide
cugggccucucuggccacu

SEQ ID NO: 6172 - RNA, 19 nt, Artificial Sequence
  Description of Artificial Sequence: Synthetic oligonucleotide
ccugggccucucuggccac

SEQ ID NO: 6173 - RNA, 19 nt, Artificial Sequence
  Description of Artificial Sequence: Synthetic oligonucleotide
cccugggccucucuggcca

SEQ ID NO: 6174 - RNA, 19 nt, Artificial Sequence
  Description of Artificial Sequence: Synthetic oligonucleotide
ccccugggccucucuggcc

SEQ ID NO: 6175 - RNA, 19 nt, Artificial Sequence
  Description of Artificial Sequence: Synthetic oligonucleotide
uccccugggccucucuggc

SEQ ID NO: 6176 - RNA, 19 nt, Artificial Sequence
  Description of Artificial Sequence: Synthetic oligonucleotide
guccccugggccucucugg

SEQ ID NO: 6177 - RNA, 19 nt, Artificial Sequence
  Description of Artificial Sequence: Synthetic oligonucleotide
uguccccugggccucucug

SEQ ID NO: 6178 - RNA, 19 nt, Artificial Sequence
  Description of Artificial Sequence: Synthetic oligonucleotide
cuguccccugggccucucu

SEQ ID NO: 6179 - RNA, 19 nt, Artificial Sequence
  Description of Artificial Sequence: Synthetic oligonucleotide
gcuguccccugggccucuc

SEQ ID NO: 6180 - RNA, 19 nt, Artificial Sequence
  Description of Artificial Sequence: Synthetic oligonucleotide
ggcuguccccugggccucu

SEQ ID NO: 6181 - RNA, 19 nt, Artificial Sequence
  Description of Artificial Sequence: Synthetic oligonucleotide
uggcuguccccugggccuc

SEQ ID NO: 6182 - RNA, 19 nt, Artificial Sequence
  Description of Artificial Sequence: Synthetic oligonucleotide
cuggcuguccccugggccu

SEQ ID NO: 6183 - RNA, 19 nt, Artificial Sequence
  Description of Artificial Sequence: Synthetic oligonucleotide
ccuggcuguccccugggcc

SEQ ID NO: 6184 - RNA, 19 nt, Artificial Sequence
  Description of Artificial Sequence: Synthetic oligonucleotide
cccuggcuguccccugggc

SEQ ID NO: 6185 - RNA, 19 nt, Artificial Sequence
  Description of Artificial Sequence: Synthetic oligonucleotide
ucccuggcuguccccuggg

SEQ ID NO: 6186 - RNA, 19 nt, Artificial Sequence
  Description of Artificial Sequence: Synthetic oligonucleotide
gucccuggcuguccccugg

SEQ ID NO: 6187 - RNA, 19 nt, Artificial Sequence
  Description of Artificial Sequence: Synthetic oligonucleotide
ugucccuggcuguccccug

SEQ ID NO: 6188 - RNA, 19 nt, Artificial Sequence
  Description of Artificial Sequence: Synthetic oligonucleotide
cugucccuggcuguccccu

SEQ ID NO: 6189 - RNA, 19 nt, Artificial Sequence
  Description of Artificial Sequence: Synthetic oligonucleotide
ccugucccuggcugucccc

SEQ ID NO: 6190 - RNA, 19 nt, Artificial Sequence
  Description of Artificial Sequence: Synthetic oligonucleotide
gccugucccuggcuguccc

SEQ ID NO: 6191 - RNA, 19 nt, Artificial Sequence
  Description of Artificial Sequence: Synthetic oligonucleotide
ugccugucccuggcugucc

SEQ ID NO: 6192 - RNA, 19 nt, Artificial Sequence
  Description of Artificial Sequence: Synthetic oligonucleotide
cugccugucccuggcuguc

SEQ ID NO: 6193 - RNA, 19 nt, Artificial Sequence
  Description of Artificial Sequence: Synthetic oligonucleotide
ucugccugucccuggcugu

SEQ ID NO: 6194 - RNA, 19 nt, Artificial Sequence
  Description of Artificial Sequence: Synthetic oligonucleotide
gucugccugucccuggcug

SEQ ID NO: 6195 - RNA, 19 nt, Artificial Sequence
  Description of Artificial Sequence: Synthetic oligonucleotide
ugucugccugucccuggcu

SEQ ID NO: 6196 - RNA, 19 nt, Artificial Sequence
  Description of Artificial Sequence: Synthetic oligonucleotide
augucugccugucccuggc

SEQ ID NO: 6197 - RNA, 19 nt, Artificial Sequence
  Description of Artificial Sequence: Synthetic oligonucleotide
caugucugccugucccugg

SEQ ID NO: 6198 - RNA, 19 nt, Artificial Sequence
  Description of Artificial Sequence: Synthetic oligonucleotide
gcaugucugccugucccug

SEQ ID NO: 6199 - RNA, 19 nt, Artificial Sequence
  Description of Artificial Sequence: Synthetic oligonucleotide
ugcaugucugccugucccu

SEQ ID NO: 6200 - RNA, 19 nt, Artificial Sequence
  Description of Artificial Sequence: Synthetic oligonucleotide
cugcaugucugccuguccc

SEQ ID NO: 6201 - RNA, 19 nt, Artificial Sequence
  Description of Artificial Sequence: Synthetic oligonucleotide
gcugcaugucugccugucc

SEQ ID NO: 6202 - RNA, 19 nt, Artificial Sequence
  Description of Artificial Sequence: Synthetic oligonucleotide
ggcugcaugucugccuguc

SEQ ID NO: 6203 - RNA, 19 nt, Artificial Sequence
  Description of Artificial Sequence: Synthetic oligonucleotide
uggcugcaugucugccugu

SEQ ID NO: 6204 - RNA, 19 nt, Artificial Sequence
  Description of Artificial Sequence: Synthetic oligonucleotide
cuggcugcaugucugccug

SEQ ID NO: 6205 - RNA, 19 nt, Artificial Sequence
  Description of Artificial Sequence: Synthetic oligonucleotide
ccuggcugcaugucugccu

SEQ ID NO: 6206 - RNA, 19 nt, Artificial Sequence
  Description of Artificial Sequence: Synthetic oligonucleotide
cccuggcugcaugucugcc

SEQ ID NO: 6207 - RNA, 19 nt, Artificial Sequence
  Description of Artificial Sequence: Synthetic oligonucleotide
gcccuggcugcaugucugc

SEQ ID NO: 6208 - RNA, 19 nt, Artificial Sequence
  Description of Artificial Sequence: Synthetic oligonucleotide
agcccuggcugcaugucug

SEQ ID NO: 6209 - RNA, 19 nt, Artificial Sequence
  Description of Artificial Sequence: Synthetic oligonucleotide
gagcccuggcugcaugucu

SEQ ID NO: 6210 - RNA, 19 nt, Artificial Sequence
  Description of Artificial Sequence: Synthetic oligonucleotide
ggagcccuggcugcauguc

SEQ ID NO: 6211 - RNA, 19 nt, Artificial Sequence
  Description of Artificial Sequence: Synthetic oligonucleotide
uggagcccuggcugcaugu

SEQ ID NO: 6212 - RNA, 19 nt, Artificial Sequence
  Description of Artificial Sequence: Synthetic oligonucleotide
cuggagcccuggcugcaug

SEQ ID NO: 6213 - RNA, 19 nt, Artificial Sequence
  Description of Artificial Sequence: Synthetic oligonucleotide
ccuggagcccuggcugcau

SEQ ID NO: 6214 - RNA, 19 nt, Artificial Sequence
  Description of Artificial Sequence: Synthetic oligonucleotide
cccuggagcccuggcugca

SEQ ID NO: 6215 - RNA, 19 nt, Artificial Sequence
  Description of Artificial Sequence: Synthetic oligonucleotide
gcccuggagcccuggcugc

SEQ ID NO: 6216 - RNA, 19 nt, Artificial Sequence
  Description of Artificial Sequence: Synthetic oligonucleotide
ggcccuggagcccuggcug

SEQ ID NO: 6217 - RNA, 19 nt, Artificial Sequence
  Description of Artificial Sequence: Synthetic oligonucleotide
aggcccuggagcccuggcu

SEQ ID NO: 6218 - RNA, 19 nt, Artificial Sequence
  Description of Artificial Sequence: Synthetic oligonucleotide
caggcccuggagcccuggc

SEQ ID NO: 6219 - RNA, 19 nt, Artificial Sequence
  Description of Artificial Sequence: Synthetic oligonucleotide
ccaggcccuggagcccugg

SEQ ID NO: 6220 - RNA, 19 nt, Artificial Sequence
  Description of Artificial Sequence: Synthetic oligonucleotide
uccaggcccuggagcccug

SEQ ID NO: 6221 - RNA, 19 nt, Artificial Sequence
  Description of Artificial Sequence: Synthetic oligonucleotide
guccaggcccuggagcccu

SEQ ID NO: 6222 - RNA, 19 nt, Artificial Sequence
  Description of Artificial Sequence: Synthetic oligonucleotide
uguccaggcccuggagccc

SEQ ID NO: 6223 - RNA, 19 nt, Artificial Sequence
  Description of Artificial Sequence: Synthetic oligonucleotide
cuguccaggcccuggagcc

SEQ ID NO: 6224 - RNA, 19 nt, Artificial Sequence
  Description of Artificial Sequence: Synthetic oligonucleotide
ccuguccaggcccuggagc

SEQ ID NO: 6225 - RNA, 19 nt, Artificial Sequence
  Description of Artificial Sequence: Synthetic oligonucleotide
cccuguccaggcccuggag

SEQ ID NO: 6226 - RNA, 19 nt, Artificial Sequence
  Description of Artificial Sequence: Synthetic oligonucleotide
ccccuguccaggcccugga

SEQ ID NO: 6227 - RNA, 19 nt, Artificial Sequence
  Description of Artificial Sequence: Synthetic oligonucleotide
gccccuguccaggcccugg

SEQ ID NO: 6228 - RNA, 19 nt, Artificial Sequence
  Description of Artificial Sequence: Synthetic oligonucleotide
agccccuguccaggcccug

SEQ ID NO: 6229 - RNA, 19 nt, Artificial Sequence
  Description of Artificial Sequence: Synthetic oligonucleotide
cagccccuguccaggcccu

SEQ ID NO: 6230 - RNA, 19 nt, Artificial Sequence
  Description of Artificial Sequence: Synthetic oligonucleotide
gcagccccuguccaggccc

SEQ ID NO: 6231 - RNA, 19 nt, Artificial Sequence
  Description of Artificial Sequence: Synthetic oligonucleotide
ggcagccccuguccaggcc

SEQ ID NO: 6232 - RNA, 19 nt, Artificial Sequence
  Description of Artificial Sequence: Synthetic oligonucleotide
uggcagccccuguccaggc

SEQ ID NO: 6233 - RNA, 19 nt, Artificial Sequence
  Description of Artificial Sequence: Synthetic oligonucleotide
cuggcagccccuguccagg

SEQ ID NO: 6234 - RNA, 19 nt, Artificial Sequence
  Description of Artificial Sequence: Synthetic oligonucleotide
ccuggcagccccuguccag

SEQ ID NO: 6235 - RNA, 19 nt, Artificial Sequence
  Description of Artificial Sequence: Synthetic oligonucleotide
gccuggcagccccugucca

SEQ ID NO: 6236 - RNA, 19 nt, Artificial Sequence
  Description of Artificial Sequence: Synthetic oligonucleotide
ggccuggcagccccugucc

SEQ ID NO: 6237 - RNA, 19 nt, Artificial Sequence
  Description of Artificial Sequence: Synthetic oligonucleotide
gggccuggcagccccuguc

SEQ ID NO: 6238 - RNA, 19 nt, Artificial Sequence
  Description of Artificial Sequence: Synthetic oligonucleotide
agggccuggcagccccugu

SEQ ID NO: 6239 - RNA, 19 nt, Artificial Sequence
  Description of Artificial Sequence: Synthetic oligonucleotide
cagggccuggcagccccug

SEQ ID NO: 6240 - RNA, 19 nt, Artificial Sequence
  Description of Artificial Sequence: Synthetic oligonucleotide
acagggccuggcagccccu

SEQ ID NO: 6241 - RNA, 19 nt, Artificial Sequence
  Description of Artificial Sequence: Synthetic oligonucleotide
cacagggccuggcagcccc

SEQ ID NO: 6242 - RNA, 19 nt, Artificial Sequence
  Description of Artificial Sequence: Synthetic oligonucleotide
ucacagggccuggcagccc

SEQ ID NO: 6243 - RNA, 19 nt, Artificial Sequence
  Description of Artificial Sequence: Synthetic oligonucleotide
gucacagggccuggcagcc

SEQ ID NO: 6244 - RNA, 19 nt, Artificial Sequence
  Description of Artificial Sequence: Synthetic oligonucleotide
ugucacagggccuggcagc

SEQ ID NO: 6245 - RNA, 19 nt, Artificial Sequence
  Description of Artificial Sequence: Synthetic oligonucleotide
cugucacagggccuggcag

SEQ ID NO: 6246 - RNA, 19 nt, Artificial Sequence
  Description of Artificial Sequence: Synthetic oligonucleotide
ccugucacagggccuggca

SEQ ID NO: 6247 - RNA, 19 nt, Artificial Sequence
  Description of Artificial Sequence: Synthetic oligonucleotide
uccugucacagggccuggc

SEQ ID NO: 6248 - RNA, 19 nt, Artificial Sequence
  Description of Artificial Sequence: Synthetic oligonucleotide
cuccugucacagggccugg

SEQ ID NO: 6249 - RNA, 19 nt, Artificial Sequence
  Description of Artificial Sequence: Synthetic oligonucleotide
ccuccugucacagggccug

SEQ ID NO: 6250 - RNA, 19 nt, Artificial Sequence
  Description of Artificial Sequence: Synthetic oligonucleotide
uccuccugucacagggccu

SEQ ID NO: 6251 - RNA, 19 nt, Artificial Sequence
  Description of Artificial Sequence: Synthetic oligonucleotide
guccuccugucacagggcc

SEQ ID NO: 6252 - RNA, 19 nt, Artificial Sequence
  Description of Artificial Sequence: Synthetic oligonucleotide
gguccuccugucacagggc

SEQ ID NO: 6253 - RNA, 19 nt, Artificial Sequence
  Description of Artificial Sequence: Synthetic oligonucleotide
ggguccuccugucacaggg

SEQ ID NO: 6254 - RNA, 19 nt, Artificial Sequence
  Description of Artificial Sequence: Synthetic oligonucleotide
gggguccuccugucacagg

SEQ ID NO: 6255 - RNA, 19 nt, Artificial Sequence
  Description of Artificial Sequence: Synthetic oligonucleotide
cgggguccuccugucacag

SEQ ID NO: 6256 - RNA, 19 nt, Artificial Sequence
  Description of Artificial Sequence: Synthetic oligonucleotide
ucgggguccuccugucaca

SEQ ID NO: 6257 - RNA, 19 nt, Artificial Sequence
  Description of Artificial Sequence: Synthetic oligonucleotide
cucgggguccuccugucac

SEQ ID NO: 6258 - RNA, 19 nt, Artificial Sequence
  Description of Artificial Sequence: Synthetic oligonucleotide
gcucgggguccuccuguca

SEQ ID NO: 6259 - RNA, 19 nt, Artificial Sequence
  Description of Artificial Sequence: Synthetic oligonucleotide
ggcucgggguccuccuguc

SEQ ID NO: 6260 - RNA, 19 nt, Artificial Sequence
  Description of Artificial Sequence: Synthetic oligonucleotide
gggcucgggguccuccugu

SEQ ID NO: 6261 - RNA, 19 nt, Artificial Sequence
  Description of Artificial Sequence: Synthetic oligonucleotide
ggggcucgggguccuccug

SEQ ID NO: 6262 - RNA, 19 nt, Artificial Sequence
  Description of Artificial Sequence: Synthetic oligonucleotide
gggggcucgggguccuccu

SEQ ID NO: 6263 - RNA, 19 nt, Artificial Sequence
  Description of Artificial Sequence: Synthetic oligonucleotide
cgggggcucgggguccucc

SEQ ID NO: 6264 - RNA, 19 nt, Artificial Sequence
  Description of Artificial Sequence: Synthetic oligonucleotide
ccgggggcucgggguccuc

SEQ ID NO: 6265 - RNA, 19 nt, Artificial Sequence
  Description of Artificial Sequence: Synthetic oligonucleotide
gccgggggcucgggguccu

SEQ ID NO: 6266 - RNA, 19 nt, Artificial Sequence
  Description of Artificial Sequence: Synthetic oligonucleotide
ggccgggggcucggggucc

SEQ ID NO: 6267 - RNA, 19 nt, Artificial Sequence
  Description of Artificial Sequence: Synthetic oligonucleotide
gggccgggggcucgggguc

SEQ ID NO: 6268 - RNA, 19 nt, Artificial Sequence
  Description of Artificial Sequence: Synthetic oligonucleotide
cgggccgggggcucggggu

SEQ ID NO: 6269 - RNA, 19 nt, Artificial Sequence
  Description of Artificial Sequence: Synthetic oligonucleotide
ccgggccgggggcucgggg

SEQ ID NO: 6270 - RNA, 19 nt, Artificial Sequence
  Description of Artificial Sequence: Synthetic oligonucleotide
cccgggccgggggcucggg

SEQ ID NO: 6271 - RNA, 19 nt, Artificial Sequence
  Description of Artificial Sequence: Synthetic oligonucleotide
ccccgggccgggggcucgg

SEQ ID NO: 6272 - RNA, 19 nt, Artificial Sequence
  Description of Artificial Sequence: Synthetic oligonucleotide
uccccgggccgggggcucg

SEQ ID NO: 6273 - RNA, 19 nt, Artificial Sequence
  Description of Artificial Sequence: Synthetic oligonucleotide
cuccccgggccgggggcuc

SEQ ID NO: 6274 - RNA, 19 nt, Artificial Sequence
  Description of Artificial Sequence: Synthetic oligonucleotide
ccuccccgggccgggggcu

SEQ ID NO: 6275 - RNA, 19 nt, Artificial Sequence
  Description of Artificial Sequence: Synthetic oligonucleotide
cccuccccgggccgggggc

SEQ ID NO: 6276 - RNA, 19 nt, Artificial Sequence
  Description of Artificial Sequence: Synthetic oligonucleotide
ccccuccccgggccggggg

SEQ ID NO: 6277 - RNA, 19 nt, Artificial Sequence
  Description of Artificial Sequence: Synthetic oligonucleotide
gccccuccccgggccgggg

SEQ ID NO: 6278 - RNA, 19 nt, Artificial Sequence
  Description of Artificial Sequence: Synthetic oligonucleotide
ggccccuccccgggccggg

SEQ ID NO: 6279 - RNA, 19 nt, Artificial Sequence
  Description of Artificial Sequence: Synthetic oligonucleotide
uggccccuccccgggccgg

SEQ ID NO: 6280 - RNA, 19 nt, Artificial Sequence
  Description of Artificial Sequence: Synthetic oligonucleotide
auggccccuccccgggccg

SEQ ID NO: 6281 - RNA, 19 nt, Artificial Sequence
  Description of Artificial Sequence: Synthetic oligonucleotide
cauggccccuccccgggcc

SEQ ID NO: 6282 - RNA, 19 nt, Artificial Sequence
  Description of Artificial Sequence: Synthetic oligonucleotide
ccauggccccuccccgggc

SEQ ID NO: 6283 - RNA, 19 nt, Artificial Sequence
  Description of Artificial Sequence: Synthetic oligonucleotide
accauggccccuccccggg

SEQ ID NO: 6284 - RNA, 19 nt, Artificial Sequence
  Description of Artificial Sequence: Synthetic oligonucleotide
caccauggccccuccccgg

SEQ ID NO: 6285 - RNA, 19 nt, Artificial Sequence
  Description of Artificial Sequence: Synthetic oligonucleotide
gcaccauggccccuccccg

SEQ ID NO: 6286 - RNA, 19 nt, Artificial Sequence
  Description of Artificial Sequence: Synthetic oligonucleotide
agcaccauggccccucccc

SEQ ID NO: 6287 - RNA, 19 nt, Artificial Sequence
  Description of Artificial Sequence: Synthetic oligonucleotide
cagcaccauggccccuccc

SEQ ID NO: 6288 - RNA, 19 nt, Artificial Sequence
  Description of Artificial Sequence: Synthetic oligonucleotide
gcagcaccauggccccucc

SEQ ID NO: 6289 - RNA, 19 nt, Artificial Sequence
  Description of Artificial Sequence: Synthetic oligonucleotide
ggcagcaccauggccccuc

SEQ ID NO: 6290 - RNA, 19 nt, Artificial Sequence
  Description of Artificial Sequence: Synthetic oligonucleotide
aggcagcaccauggccccu

SEQ ID NO: 6291 - RNA, 19 nt, Artificial Sequence
  Description of Artificial Sequence: Synthetic oligonucleotide
caggcagcaccauggcccc

SEQ ID NO: 6292 - RNA, 19 nt, Artificial Sequence
  Description of Artificial Sequence: Synthetic oligonucleotide
acaggcagcaccauggccc

SEQ ID NO: 6293 - RNA, 19 nt, Artificial Sequence
  Description of Artificial Sequence: Synthetic oligonucleotide
gacaggcagcaccauggcc

SEQ ID NO: 6294 - RNA, 19 nt, Artificial Sequence
  Description of Artificial Sequence: Synthetic oligonucleotide
ggacaggcagcaccauggc

SEQ ID NO: 6295 - RNA, 19 nt, Artificial Sequence
  Description of Artificial Sequence: Synthetic oligonucleotide
uggacaggcagcaccaugg

SEQ ID NO: 6296 - RNA, 19 nt, Artificial Sequence
  Description of Artificial Sequence: Synthetic oligonucleotide
uuggacaggcagcaccaug

SEQ ID NO: 6297 - RNA, 19 nt, Artificial Sequence
  Description of Artificial Sequence: Synthetic oligonucleotide
guuggacaggcagcaccau

SEQ ID NO: 6298 - RNA, 19 nt, Artificial Sequence
  Description of Artificial Sequence: Synthetic oligonucleotide
uguuggacaggcagcacca

SEQ ID NO: 6299 - RNA, 19 nt, Artificial Sequence
  Description of Artificial Sequence: Synthetic oligonucleotide
auguuggacaggcagcacc

SEQ ID NO: 6300 - RNA, 19 nt, Artificial Sequence
  Description of Artificial Sequence: Synthetic oligonucleotide
cauguuggacaggcagcac

SEQ ID NO: 6301 - RNA, 19 nt, Artificial Sequence
  Description of Artificial Sequence: Synthetic oligonucleotide
acauguuggacaggcagca

SEQ ID NO: 6302 - RNA, 19 nt, Artificial Sequence
  Description of Artificial Sequence: Synthetic oligonucleotide
gacauguuggacaggcagc

SEQ ID NO: 6303 - RNA, 19 nt, Artificial Sequence
  Description of Artificial Sequence: Synthetic oligonucleotide
ugacauguuggacaggcag

SEQ ID NO: 6304 - RNA, 19 nt, Artificial Sequence
  Description of Artificial Sequence: Synthetic oligonucleotide
cugacauguuggacaggca

SEQ ID NO: 6305 - RNA, 19 nt, Artificial Sequence
  Description of Artificial Sequence: Synthetic oligonucleotide
gcugacauguuggacaggc

SEQ ID NO: 6306 - RNA, 19 nt, Artificial Sequence
  Description of Artificial Sequence: Synthetic oligonucleotide
ggcugacauguuggacagg

SEQ ID NO: 6307 - RNA, 19 nt, Artificial Sequence
  Description of Artificial Sequence: Synthetic oligonucleotide
cggcugacauguuggacag

SEQ ID NO: 6308 - RNA, 19 nt, Artificial Sequence
  Description of Artificial Sequence: Synthetic oligonucleotide
ucggcugacauguuggaca

SEQ ID NO: 6309 - RNA, 19 nt, Artificial Sequence
  Description of Artificial Sequence: Synthetic oligonucleotide
cucggcugacauguuggac

SEQ ID NO: 6310 - RNA, 19 nt, Artificial Sequence
  Description of Artificial Sequence: Synthetic oligonucleotide
ccucggcugacauguugga

SEQ ID NO: 6311 - RNA, 19 nt, Artificial Sequence
  Description of Artificial Sequence: Synthetic oligonucleotide
accucggcugacauguugg

SEQ ID NO: 6312 - RNA, 19 nt, Artificial Sequence
  Description of Artificial Sequence: Synthetic oligonucleotide
caccucggcugacauguug

SEQ ID NO: 6313 - RNA, 19 nt, Artificial Sequence
  Description of Artificial Sequence: Synthetic oligonucleotide
gcaccucggcugacauguu

SEQ ID NO: 6314 - RNA, 19 nt, Artificial Sequence
  Description of Artificial Sequence: Synthetic oligonucleotide
cgcaccucggcugacaugu

SEQ ID NO: 6315 - RNA, 19 nt, Artificial Sequence
  Description of Artificial Sequence: Synthetic oligonucleotide
ccgcaccucggcugacaug

SEQ ID NO: 6316 - RNA, 19 nt, Artificial Sequence
  Description of Artificial Sequence: Synthetic oligonucleotide
gccgcaccucggcugacau

SEQ ID NO: 6317 - RNA, 19 nt, Artificial Sequence
  Description of Artificial Sequence: Synthetic oligonucleotide
agccgcaccucggcugaca

SEQ ID NO: 6318 - RNA, 19 nt, Artificial Sequence
  Description of Artificial Sequence: Synthetic oligonucleotide
cagccgcaccucggcugac

SEQ ID NO: 6319 - RNA, 19 nt, Artificial Sequence
  Description of Artificial Sequence: Synthetic oligonucleotide
ucagccgcaccucggcuga

SEQ ID NO: 6320 - RNA, 19 nt, Artificial Sequence
  Description of Artificial Sequence: Synthetic oligonucleotide
cucagccgcaccucggcug

SEQ ID NO: 6321 - RNA, 19 nt, Artificial Sequence
  Description of Artificial Sequence: Synthetic oligonucleotide
ccucagccgcaccucggcu

SEQ ID NO: 6322 - RNA, 19 nt, Artificial Sequence
  Description of Artificial Sequence: Synthetic oligonucleotide
gccucagccgcaccucggc

SEQ ID NO: 6323 - RNA, 19 nt, Artificial Sequence
  Description of Artificial Sequence: Synthetic oligonucleotide
cgccucagccgcaccucgg

SEQ ID NO: 6324 - RNA, 19 nt, Artificial Sequence
  Description of Artificial Sequence: Synthetic oligonucleotide
ccgccucagccgcaccucg

SEQ ID NO: 6325 - RNA, 19 nt, Artificial Sequence
  Description of Artificial Sequence: Synthetic oligonucleotide
gccgccucagccgcaccuc

SEQ ID NO: 6326 - RNA, 19 nt, Artificial Sequence
  Description of Artificial Sequence: Synthetic oligonucleotide
agccgccucagccgcaccu

SEQ ID NO: 6327 - RNA, 19 nt, Artificial Sequence
  Description of Artificial Sequence: Synthetic oligonucleotide
gagccgccucagccgcacc

SEQ ID NO: 6328 - RNA, 19 nt, Artificial Sequence
  Description of Artificial Sequence: Synthetic oligonucleotide
ggagccgccucagccgcac

SEQ ID NO: 6329 - RNA, 19 nt, Artificial Sequence
  Description of Artificial Sequence: Synthetic oligonucleotide
uggagccgccucagccgca

SEQ ID NO: 6330 - RNA, 19 nt, Artificial Sequence
  Description of Artificial Sequence: Synthetic oligonucleotide
cuggagccgccucagccgc

SEQ ID NO: 6331 - RNA, 19 nt, Artificial Sequence
  Description of Artificial Sequence: Synthetic oligonucleotide
gcuggagccgccucagccg

SEQ ID NO: 6332 - RNA, 19 nt, Artificial Sequence
  Description of Artificial Sequence: Synthetic oligonucleotide
ugcuggagccgccucagcc

SEQ ID NO: 6333 - RNA, 19 nt, Artificial Sequence
  Description of Artificial Sequence: Synthetic oligonucleotide
cugcuggagccgccucagc

SEQ ID NO: 6334 - RNA, 19 nt, Artificial Sequence
  Description of Artificial Sequence: Synthetic oligonucleotide
gcugcuggagccgccucag

SEQ ID NO: 6335 - RNA, 19 nt, Artificial Sequence
  Description of Artificial Sequence: Synthetic oligonucleotide
agcugcuggagccgccuca

SEQ ID NO: 6336 - RNA, 19 nt, Artificial Sequence
  Description of Artificial Sequence: Synthetic oligonucleotide
cagcugcuggagccgccuc

SEQ ID NO: 6337 - RNA, 19 nt, Artificial Sequence
  Description of Artificial Sequence: Synthetic oligonucleotide
ccagcugcuggagccgccu

SEQ ID NO: 6338 - RNA, 19 nt, Artificial Sequence
  Description of Artificial Sequence: Synthetic oligonucleotide
accagcugcuggagccgcc

SEQ ID NO: 6339 - RNA, 19 nt, Artificial Sequence
  Description of Artificial Sequence: Synthetic oligonucleotide
caccagcugcuggagccgc

SEQ ID NO: 6340 - RNA, 19 nt, Artificial Sequence
  Description of Artificial Sequence: Synthetic oligonucleotide
acaccagcugcuggagccg

SEQ ID NO: 6341 - RNA, 19 nt, Artificial Sequence
  Description of Artificial Sequence: Synthetic oligonucleotide
aacaccagcugcuggagcc

SEQ ID NO: 6342 - RNA, 19 nt, Artificial Sequence
  Description of Artificial Sequence: Synthetic oligonucleotide
caacaccagcugcuggagc

SEQ ID NO: 6343 - RNA, 19 nt, Artificial Sequence
  Description of Artificial Sequence: Synthetic oligonucleotide
ccaacaccagcugcuggag

SEQ ID NO: 6344 - RNA, 19 nt, Artificial Sequence
  Description of Artificial Sequence: Synthetic oligonucleotide
uccaacaccagcugcugga

SEQ ID NO: 6345 - RNA, 19 nt, Artificial Sequence
  Description of Artificial Sequence: Synthetic oligonucleotide
guccaacaccagcugcugg

SEQ ID NO: 6346 - RNA, 19 nt, Artificial Sequence
  Description of Artificial Sequence: Synthetic oligonucleotide
gguccaacaccagcugcug

SEQ ID NO: 6347 - RNA, 19 nt, Artificial Sequence
  Description of Artificial Sequence: Synthetic oligonucleotide
ggguccaacaccagcugcu

SEQ ID NO: 6348 - RNA, 19 nt, Artificial Sequence
  Description of Artificial Sequence: Synthetic oligonucleotide
cggguccaacaccagcugc

SEQ ID NO: 6349 - RNA, 19 nt, Artificial Sequence
  Description of Artificial Sequence: Synthetic oligonucleotide
ccggguccaacaccagcug

SEQ ID NO: 6350 - RNA, 19 nt, Artificial Sequence
  Description of Artificial Sequence: Synthetic oligonucleotide
cccggguccaacaccagcu

SEQ ID NO: 6351 - RNA, 19 nt, Artificial Sequence
  Description of Artificial Sequence: Synthetic oligonucleotide
gcccggguccaacaccagc

SEQ ID NO: 6352 - RNA, 19 nt, Artificial Sequence
  Description of Artificial Sequence: Synthetic oligonucleotide
agcccggguccaacaccag

SEQ ID NO: 6353 - RNA, 19 nt, Artificial Sequence
  Description of Artificial Sequence: Synthetic oligonucleotide
aagcccggguccaacacca

SEQ ID NO: 6354 - RNA, 19 nt, Artificial Sequence
  Description of Artificial Sequence: Synthetic oligonucleotide
gaagcccggguccaacacc

SEQ ID NO: 6355 - RNA, 19 nt, Artificial Sequence
  Description of Artificial Sequence: Synthetic oligonucleotide
ggaagcccggguccaacac

SEQ ID NO: 6356 - RNA, 19 nt, Artificial Sequence
  Description of Artificial Sequence: Synthetic oligonucleotide
aggaagcccggguccaaca

SEQ ID NO: 6357 - RNA, 19 nt, Artificial Sequence
  Description of Artificial Sequence: Synthetic oligonucleotide
caggaagcccggguccaac

SEQ ID NO: 6358 - RNA, 19 nt, Artificial Sequence
  Description of Artificial Sequence: Synthetic oligonucleotide
ccaggaagcccggguccaa

SEQ ID NO: 6359 - RNA, 19 nt, Artificial Sequence
  Description of Artificial Sequence: Synthetic oligonucleotide
cccaggaagcccgggucca

SEQ ID NO: 6360 - RNA, 19 nt, Artificial Sequence
  Description of Artificial Sequence: Synthetic oligonucleotide
ccccaggaagcccgggucc

SEQ ID NO: 6361 - RNA, 19 nt, Artificial Sequence
  Description of Artificial Sequence: Synthetic oligonucleotide
gccccaggaagcccggguc

SEQ ID NO: 6362 - RNA, 19 nt, Artificial Sequence
  Description of Artificial Sequence: Synthetic oligonucleotide
agccccaggaagcccgggu

SEQ ID NO: 6363 - RNA, 19 nt, Artificial Sequence
  Description of Artificial Sequence: Synthetic oligonucleotide
cagccccaggaagcccggg

SEQ ID NO: 6364 - RNA, 19 nt, Artificial Sequence
  Description of Artificial Sequence: Synthetic oligonucleotide
ccagccccaggaagcccgg

SEQ ID NO: 6365 - RNA, 19 nt, Artificial Sequence
  Description of Artificial Sequence: Synthetic oligonucleotide
uccagccccaggaagcccg

SEQ ID NO: 6366 - RNA, 19 nt, Artificial Sequence
  Description of Artificial Sequence: Synthetic oligonucleotide
cuccagccccaggaagccc

SEQ ID NO: 6367 - RNA, 19 nt, Artificial Sequence
  Description of Artificial Sequence: Synthetic oligonucleotide
gcuccagccccaggaagcc

SEQ ID NO: 6368 - RNA, 19 nt, Artificial Sequence
  Description of Artificial Sequence: Synthetic oligonucleotide
ggcuccagccccaggaagc

SEQ ID NO: 6369 - RNA, 19 nt, Artificial Sequence
  Description of Artificial Sequence: Synthetic oligonucleotide
gggcuccagccccaggaag

SEQ ID NO: 6370 - RNA, 19 nt, Artificial Sequence
  Description of Artificial Sequence: Synthetic oligonucleotide
ggggcuccagccccaggaa

SEQ ID NO: 6371 - RNA, 19 nt, Artificial Sequence
  Description of Artificial Sequence: Synthetic oligonucleotide
aggggcuccagccccagga

SEQ ID NO: 6372 - RNA, 19 nt, Artificial Sequence
  Description of Artificial Sequence: Synthetic oligonucleotide
caggggcuccagccccagg

SEQ ID NO: 6373 - RNA, 19 nt, Artificial Sequence
  Description of Artificial Sequence: Synthetic oligonucleotide
gcaggggcuccagccccag

SEQ ID NO: 6374 - RNA, 19 nt, Artificial Sequence
  Description of Artificial Sequence: Synthetic oligonucleotide
agcaggggcuccagcccca

SEQ ID NO: 6375 - RNA, 19 nt, Artificial Sequence
  Description of Artificial Sequence: Synthetic oligonucleotide
gagcaggggcuccagcccc

SEQ ID NO: 6376 - RNA, 19 nt, Artificial Sequence
  Description of Artificial Sequence: Synthetic oligonucleotide
cgagcaggggcuccagccc

SEQ ID NO: 6377 - RNA, 19 nt, Artificial Sequence
  Description of Artificial Sequence: Synthetic oligonucleotide
ucgagcaggggcuccagcc

SEQ ID NO: 6378 - RNA, 19 nt, Artificial Sequence
  Description of Artificial Sequence: Synthetic oligonucleotide
gucgagcaggggcuccagc

SEQ ID NO: 6379 - RNA, 19 nt, Artificial Sequence
  Description of Artificial Sequence: Synthetic oligonucleotide
ggucgagcaggggcuccag

SEQ ID NO: 6380 - RNA, 19 nt, Artificial Sequence
  Description of Artificial Sequence: Synthetic oligonucleotide
aggucgagcaggggcucca

SEQ ID NO: 6381 - RNA, 19 nt, Artificial Sequence
  Description of Artificial Sequence: Synthetic oligonucleotide
aaggucgagcaggggcucc

SEQ ID NO: 6382 - RNA, 19 nt, Artificial Sequence
  Description of Artificial Sequence: Synthetic oligonucleotide
gaaggucgagcaggggcuc

SEQ ID NO: 6383 - RNA, 19 nt, Artificial Sequence
  Description of Artificial Sequence: Synthetic oligonucleotide
agaaggucgagcaggggcu

SEQ ID NO: 6384 - RNA, 19 nt, Artificial Sequence
  Description of Artificial Sequence: Synthetic oligonucleotide
gagaaggucgagcaggggc

SEQ ID NO: 6385 - RNA, 19 nt, Artificial Sequence
  Description of Artificial Sequence: Synthetic oligonucleotide
ggagaaggucgagcagggg

SEQ ID NO: 6386 - RNA, 19 nt, Artificial Sequence
  Description of Artificial Sequence: Synthetic oligonucleotide
aggagaaggucgagcaggg

SEQ ID NO: 6387 - RNA, 19 nt, Artificial Sequence
  Description of Artificial Sequence: Synthetic oligonucleotide
caggagaaggucgagcagg

SEQ ID NO: 6388 - RNA, 19 nt, Artificial Sequence
  Description of Artificial Sequence: Synthetic oligonucleotide
ccaggagaaggucgagcag

SEQ ID NO: 6389 - RNA, 19 nt, Artificial Sequence
  Description of Artificial Sequence: Synthetic oligonucleotide
cccaggagaaggucgagca

SEQ ID NO: 6390 - RNA, 19 nt, Artificial Sequence
  Description of Artificial Sequence: Synthetic oligonucleotide
gcccaggagaaggucgagc

SEQ ID NO: 6391 - RNA, 19 nt, Artificial Sequence
  Description of Artificial Sequence: Synthetic oligonucleotide
cgcccaggagaaggucgag

SEQ ID NO: 6392 - RNA, 19 nt, Artificial Sequence
  Description of Artificial Sequence: Synthetic oligonucleotide
acgcccaggagaaggucga

SEQ ID NO: 6393 - RNA, 19 nt, Artificial Sequence
  Description of Artificial Sequence: Synthetic oligonucleotide
gacgcccaggagaaggucg

SEQ ID NO: 6394 - RNA, 19 nt, Artificial Sequence
  Description of Artificial Sequence: Synthetic oligonucleotide
ggacgcccaggagaagguc

SEQ ID NO: 6395 - RNA, 19 nt, Artificial Sequence
  Description of Artificial Sequence: Synthetic oligonucleotide
uggacgcccaggagaaggu

SEQ ID NO: 6396 - RNA, 19 nt, Artificial Sequence
  Description of Artificial Sequence: Synthetic oligonucleotide
guggacgcccaggagaagg

SEQ ID NO: 6397 - RNA, 19 nt, Artificial Sequence
  Description of Artificial Sequence: Synthetic oligonucleotide
gguggacgcccaggagaag

SEQ ID NO: 6398 - RNA, 19 nt, Artificial Sequence
  Description of Artificial Sequence: Synthetic oligonucleotide
ugguggacgcccaggagaa

SEQ ID NO: 6399 - RNA, 19 nt, Artificial Sequence
  Description of Artificial Sequence: Synthetic oligonucleotide
cugguggacgcccaggaga

SEQ ID NO: 6400 - RNA, 19 nt, Artificial Sequence
  Description of Artificial Sequence: Synthetic oligonucleotide
ccugguggacgcccaggag

SEQ ID NO: 6401 - RNA, 19 nt, Artificial Sequence
  Description of Artificial Sequence: Synthetic oligonucleotide
uccugguggacgcccagga

SEQ ID NO: 6402 - RNA, 19 nt, Artificial Sequence
  Description of Artificial Sequence: Synthetic oligonucleotide
cuccugguggacgcccagg

SEQ ID NO: 6403 - RNA, 19 nt, Artificial Sequence
  Description of Artificial Sequence: Synthetic oligonucleotide
gcuccugguggacgcccag

SEQ ID NO: 6404 - RNA, 19 nt, Artificial Sequence
  Description of Artificial Sequence: Synthetic oligonucleotide
agcuccugguggacgccca

SEQ ID NO: 6405 - RNA, 19 nt, Artificial Sequence
  Description of Artificial Sequence: Synthetic oligonucleotide
cagcuccugguggacgccc

SEQ ID NO: 6406 - RNA, 19 nt, Artificial Sequence
  Description of Artificial Sequence: Synthetic oligonucleotide
ccagcuccugguggacgcc

SEQ ID NO: 6407 - RNA, 19 nt, Artificial Sequence
  Description of Artificial Sequence: Synthetic oligonucleotide
cccagcuccugguggacgc

SEQ ID NO: 6408 - RNA, 19 nt, Artificial Sequence
  Description of Artificial Sequence: Synthetic oligonucleotide
gcccagcuccugguggacg

SEQ ID NO: 6409 - RNA, 19 nt, Artificial Sequence
  Description of Artificial Sequence: Synthetic oligonucleotide
cgcccagcuccugguggac

SEQ ID NO: 6410 - RNA, 19 nt, Artificial Sequence
  Description of Artificial Sequence: Synthetic oligonucleotide
gcgcccagcuccuggugga

SEQ ID NO: 6411 - RNA, 19 nt, Artificial Sequence
  Description of Artificial Sequence: Synthetic oligonucleotide
ggcgcccagcuccuggugg

SEQ ID NO: 6412 - RNA, 19 nt, Artificial Sequence
  Description of Artificial Sequence: Synthetic oligonucleotide
aggcgcccagcuccuggug

SEQ ID NO: 6413 - RNA, 19 nt, Artificial Sequence
  Description of Artificial Sequence: Synthetic oligonucleotide
gaggcgcccagcuccuggu

SEQ ID NO: 6414 - RNA, 19 nt, Artificial Sequence
  Description of Artificial Sequence: Synthetic oligonucleotide
ggaggcgcccagcuccugg

SEQ ID NO: 6415 - RNA, 19 nt, Artificial Sequence
  Description of Artificial Sequence: Synthetic oligonucleotide
cggaggcgcccagcuccug

SEQ ID NO: 6416 - RNA, 19 nt, Artificial Sequence
  Description of Artificial Sequence: Synthetic oligonucleotide
ucggaggcgcccagcuccu

SEQ ID NO: 6417 - RNA, 19 nt, Artificial Sequence
  Description of Artificial Sequence: Synthetic oligonucleotide
uucggaggcgcccagcucc

SEQ ID NO: 6418 - RNA, 19 nt, Artificial Sequence
  Description of Artificial Sequence: Synthetic oligonucleotide
guucggaggcgcccagcuc

SEQ ID NO: 6419 - RNA, 19 nt, Artificial Sequence
  Description of Artificial Sequence: Synthetic oligonucleotide
aguucggaggcgcccagcu

SEQ ID NO: 6420 - RNA, 19 nt, Artificial Sequence
  Description of Artificial Sequence: Synthetic oligonucleotide
caguucggaggcgcccagc

SEQ ID NO: 6421 - RNA, 19 nt, Artificial Sequence
  Description of Artificial Sequence: Synthetic oligonucleotide
ccaguucggaggcgcccag

SEQ ID NO: 6422 - RNA, 19 nt, Artificial Sequence
  Description of Artificial Sequence: Synthetic oligonucleotide
gccaguucggaggcgccca

SEQ ID NO: 6423 - RNA, 19 nt, Artificial Sequence
  Description of Artificial Sequence: Synthetic oligonucleotide
ggccaguucggaggcgccc

SEQ ID NO: 6424 - RNA, 19 nt, Artificial Sequence
  Description of Artificial Sequence: Synthetic oligonucleotide
gggccaguucggaggcgcc

SEQ ID NO: 6425 - RNA, 19 nt, Artificial Sequence
  Description of Artificial Sequence: Synthetic oligonucleotide
ugggccaguucggaggcgc

SEQ ID NO: 6426 - RNA, 19 nt, Artificial Sequence
  Description of Artificial Sequence: Synthetic oligonucleotide
cugggccaguucggaggcg

SEQ ID NO: 6427 - RNA, 19 nt, Artificial Sequence
  Description of Artificial Sequence: Synthetic oligonucleotide
ccugggccaguucggaggc

SEQ ID NO: 6428 - RNA, 19 nt, Artificial Sequence
  Description of Artificial Sequence: Synthetic oligonucleotide
uccugggccaguucggagg

SEQ ID NO: 6429 - RNA, 19 nt, Artificial Sequence
  Description of Artificial Sequence: Synthetic oligonucleotide
guccugggccaguucggag

SEQ ID NO: 6430 - RNA, 19 nt, Artificial Sequence
  Description of Artificial Sequence: Synthetic oligonucleotide
uguccugggccaguucgga

SEQ ID NO: 6431 - RNA, 19 nt, Artificial Sequence
  Description of Artificial Sequence: Synthetic oligonucleotide
uuguccugggccaguucgg

SEQ ID NO: 6432 - RNA, 19 nt, Artificial Sequence
  Description of Artificial Sequence: Synthetic oligonucleotide
cuuguccugggccaguucg

SEQ ID NO: 6433 - RNA, 19 nt, Artificial Sequence
  Description of Artificial Sequence: Synthetic oligonucleotide
acuuguccugggccaguuc

SEQ ID NO: 6434 - RNA, 19 nt, Artificial Sequence
  Description of Artificial Sequence: Synthetic oligonucleotide
uacuuguccugggccaguu

SEQ ID NO: 6435 - RNA, 19 nt, Artificial Sequence
  Description of Artificial Sequence: Synthetic oligonucleotide
guacuuguccugggccagu

SEQ ID NO: 6436 - RNA, 19 nt, Artificial Sequence
  Description of Artificial Sequence: Synthetic oligonucleotide
cguacuuguccugggccag

SEQ ID NO: 6437 - RNA, 19 nt, Artificial Sequence
  Description of Artificial Sequence: Synthetic oligonucleotide
acguacuuguccugggcca

SEQ ID NO: 6438 - RNA, 19 nt, Artificial Sequence
  Description of Artificial Sequence: Synthetic oligonucleotide
cacguacuuguccugggcc

SEQ ID NO: 6439 - RNA, 19 nt, Artificial Sequence
  Description of Artificial Sequence: Synthetic oligonucleotide
ccacguacuuguccugggc

SEQ ID NO: 6440 - RNA, 19 nt, Artificial Sequence
  Description of Artificial Sequence: Synthetic oligonucleotide
gccacguacuuguccuggg

SEQ ID NO: 6441 - RNA, 19 nt, Artificial Sequence
  Description of Artificial Sequence: Synthetic oligonucleotide
ggccacguacuuguccugg

SEQ ID NO: 6442 - RNA, 19 nt, Artificial Sequence
  Description of Artificial Sequence: Synthetic oligonucleotide
cggccacguacuuguccug

SEQ ID NO: 6443 - RNA, 19 nt, Artificial Sequence
  Description of Artificial Sequence: Synthetic oligonucleotide
ucggccacguacuuguccu

SEQ ID NO: 6444 - RNA, 19 nt, Artificial Sequence
  Description of Artificial Sequence: Synthetic oligonucleotide
gucggccacguacuugucc

SEQ ID NO: 6445 - RNA, 19 nt, Artificial Sequence
  Description of Artificial Sequence: Synthetic oligonucleotide
agucggccacguacuuguc

SEQ ID NO: 6446 - RNA, 19 nt, Artificial Sequence
  Description of Artificial Sequence: Synthetic oligonucleotide
aagucggccacguacuugu

SEQ ID NO: 6447 - RNA, 19 nt, Artificial Sequence
  Description of Artificial Sequence: Synthetic oligonucleotide
gaagucggccacguacuug

SEQ ID NO: 6448 - RNA, 19 nt, Artificial Sequence
  Description of Artificial Sequence: Synthetic oligonucleotide
agaagucggccacguacuu

SEQ ID NO: 6449 - RNA, 19 nt, Artificial Sequence
  Description of Artificial Sequence: Synthetic oligonucleotide
aagaagucggccacguacu

SEQ ID NO: 6450 - RNA, 19 nt, Artificial Sequence
  Description of Artificial Sequence: Synthetic oligonucleotide
caagaagucggccacguac

SEQ ID NO: 6451 - RNA, 19 nt, Artificial Sequence
  Description of Artificial Sequence: Synthetic oligonucleotide
gcaagaagucggccacgua

SEQ ID NO: 6452 - RNA, 19 nt, Artificial Sequence
  Description of Artificial Sequence: Synthetic oligonucleotide
ugcaagaagucggccacgu

SEQ ID NO: 6453 - RNA, 19 nt, Artificial Sequence
  Description of Artificial Sequence: Synthetic oligonucleotide
cugcaagaagucggccacg

SEQ ID NO: 6454 - RNA, 19 nt, Artificial Sequence
  Description of Artificial Sequence: Synthetic oligonucleotide
acugcaagaagucggccac

SEQ ID NO: 6455 - RNA, 19 nt, Artificial Sequence
  Description of Artificial Sequence: Synthetic oligonucleotide
cacugcaagaagucggcca

SEQ ID NO: 6456 - RNA, 19 nt, Artificial Sequence
  Description of Artificial Sequence: Synthetic oligonucleotide
ccacugcaagaagucggcc

SEQ ID NO: 6457 - RNA, 19 nt, Artificial Sequence
  Description of Artificial Sequence: Synthetic oligonucleotide
cccacugcaagaagucggc

SEQ ID NO: 6458 - RNA, 19 nt, Artificial Sequence
  Description of Artificial Sequence: Synthetic oligonucleotide
gcccacugcaagaagucgg

SEQ ID NO: 6459 - RNA, 19 nt, Artificial Sequence
  Description of Artificial Sequence: Synthetic oligonucleotide
cgcccacugcaagaagucg

SEQ ID NO: 6460 - RNA, 19 nt, Artificial Sequence
  Description of Artificial Sequence: Synthetic oligonucleotide
ccgcccacugcaagaaguc

SEQ ID NO: 6461 - RNA, 19 nt, Artificial Sequence
  Description of Artificial Sequence: Synthetic oligonucleotide
uccgcccacugcaagaagu

SEQ ID NO: 6462 - RNA, 19 nt, Artificial Sequence
  Description of Artificial Sequence: Synthetic oligonucleotide
cuccgcccacugcaagaag

SEQ ID NO: 6463 - RNA, 19 nt, Artificial Sequence
  Description of Artificial Sequence: Synthetic oligonucleotide
gcuccgcccacugcaagaa

SEQ ID NO: 6464 - RNA, 19 nt, Artificial Sequence
  Description of Artificial Sequence: Synthetic oligonucleotide
ggcuccgcccacugcaaga

SEQ ID NO: 6465 - RNA, 19 nt, Artificial Sequence
  Description of Artificial Sequence: Synthetic oligonucleotide
gggcuccgcccacugcaag

SEQ ID NO: 6466 - RNA, 19 nt, Artificial Sequence
  Description of Artificial Sequence: Synthetic oligonucleotide
ugggcuccgcccacugcaa

SEQ ID NO: 6467 - RNA, 19 nt, Artificial Sequence
  Description of Artificial Sequence: Synthetic oligonucleotide
augggcuccgcccacugca

SEQ ID NO: 6468 - RNA, 19 nt, Artificial Sequence
  Description of Artificial Sequence: Synthetic oligonucleotide
gaugggcuccgcccacugc

SEQ ID NO: 6469 - RNA, 19 nt, Artificial Sequence
  Description of Artificial Sequence: Synthetic oligonucleotide
cgaugggcuccgcccacug

SEQ ID NO: 6470 - RNA, 19 nt, Artificial Sequence
  Description of Artificial Sequence: Synthetic oligonucleotide
acgaugggcuccgcccacu

SEQ ID NO: 6471 - RNA, 19 nt, Artificial Sequence
  Description of Artificial Sequence: Synthetic oligonucleotide
cacgaugggcuccgcccac

SEQ ID NO: 6472 - RNA, 19 nt, Artificial Sequence
  Description of Artificial Sequence: Synthetic oligonucleotide
ccacgaugggcuccgccca

SEQ ID NO: 6473 - RNA, 19 nt, Artificial Sequence
  Description of Artificial Sequence: Synthetic oligonucleotide
accacgaugggcuccgccc

SEQ ID NO: 6474 - RNA, 19 nt, Artificial Sequence
  Description of Artificial Sequence: Synthetic oligonucleotide
caccacgaugggcuccgcc

SEQ ID NO: 6475 - RNA, 19 nt, Artificial Sequence
  Description of Artificial Sequence: Synthetic oligonucleotide
ucaccacgaugggcuccgc

SEQ ID NO: 6476 - RNA, 19 nt, Artificial Sequence
  Description of Artificial Sequence: Synthetic oligonucleotide
cucaccacgaugggcuccg

SEQ ID NO: 6477 - RNA, 19 nt, Artificial Sequence
  Description of Artificial Sequence: Synthetic oligonucleotide
ccucaccacgaugggcucc

SEQ ID NO: 6478 - RNA, 19 nt, Artificial Sequence
  Description of Artificial Sequence: Synthetic oligonucleotide
gccucaccacgaugggcuc

SEQ ID NO: 6479 - RNA, 19 nt, Artificial Sequence
  Description of Artificial Sequence: Synthetic oligonucleotide
agccucaccacgaugggcu

SEQ ID NO: 6480 - RNA, 19 nt, Artificial Sequence
  Description of Artificial Sequence: Synthetic oligonucleotide
aagccucaccacgaugggc

SEQ ID NO: 6481 - RNA, 19 nt, Artificial Sequence
  Description of Artificial Sequence: Synthetic oligonucleotide
uaagccucaccacgauggg

SEQ ID NO: 6482 - RNA, 19 nt, Artificial Sequence
  Description of Artificial Sequence: Synthetic oligonucleotide
uuaagccucaccacgaugg

SEQ ID NO: 6483 - RNA, 19 nt, Artificial Sequence
  Description of Artificial Sequence: Synthetic oligonucleotide
cuuaagccucaccacgaug

SEQ ID NO: 6484 - RNA, 19 nt, Artificial Sequence
  Description of Artificial Sequence: Synthetic oligonucleotide
ccuuaagccucaccacgau

SEQ ID NO: 6485 - RNA, 19 nt, Artificial Sequence
  Description of Artificial Sequence: Synthetic oligonucleotide
uccuuaagccucaccacga

SEQ ID NO: 6486 - RNA, 19 nt, Artificial Sequence
  Description of Artificial Sequence: Synthetic oligonucleotide
cuccuuaagccucaccacg

SEQ ID NO: 6487 - RNA, 19 nt, Artificial Sequence
  Description of Artificial Sequence: Synthetic oligonucleotide
ccuccuuaagccucaccac

SEQ ID NO: 6488 - RNA, 19 nt, Artificial Sequence
  Description of Artificial Sequence: Synthetic oligonucleotide
accuccuuaagccucacca

SEQ ID NO: 6489 - RNA, 19 nt, Artificial Sequence
  Description of Artificial Sequence: Synthetic oligonucleotide
gaccuccuuaagccucacc

SEQ ID NO: 6490 - RNA, 19 nt, Artificial Sequence
  Description of Artificial Sequence: Synthetic oligonucleotide
ggaccuccuuaagccucac

SEQ ID NO: 6491 - RNA, 19 nt, Artificial Sequence
  Description of Artificial Sequence: Synthetic oligonucleotide
cggaccuccuuaagccuca

SEQ ID NO: 6492 - RNA, 19 nt, Artificial Sequence
  Description of Artificial Sequence: Synthetic oligonucleotide
ucggaccuccuuaagccuc

SEQ ID NO: 6493 - RNA, 19 nt, Artificial Sequence
  Description of Artificial Sequence: Synthetic oligonucleotide
gucggaccuccuuaagccu

SEQ ID NO: 6494 - RNA, 19 nt, Artificial Sequence
  Description of Artificial Sequence: Synthetic oligonucleotide
agucggaccuccuuaagcc

SEQ ID NO: 6495 - RNA, 19 nt, Artificial Sequence
  Description of Artificial Sequence: Synthetic oligonucleotide
cagucggaccuccuuaagc

SEQ ID NO: 6496 - RNA, 19 nt, Artificial Sequence
  Description of Artificial Sequence: Synthetic oligonucleotide
gcagucggaccuccuuaag

SEQ ID NO: 6497 - RNA, 19 nt, Artificial Sequence
  Description of Artificial Sequence: Synthetic oligonucleotide
ugcagucggaccuccuuaa

SEQ ID NO: 6498 - RNA, 19 nt, Artificial Sequence
  Description of Artificial Sequence: Synthetic oligonucleotide
cugcagucggaccuccuua

SEQ ID NO: 6499 - RNA, 19 nt, Artificial Sequence
  Description of Artificial Sequence: Synthetic oligonucleotide
ucugcagucggaccuccuu

SEQ ID NO: 6500 - RNA, 19 nt, Artificial Sequence
  Description of Artificial Sequence: Synthetic oligonucleotide
cucugcagucggaccuccu

SEQ ID NO: 6501 - RNA, 19 nt, Artificial Sequence
  Description of Artificial Sequence: Synthetic oligonucleotide
ccucugcagucggaccucc

SEQ ID NO: 6502 - RNA, 19 nt, Artificial Sequence
  Description of Artificial Sequence: Synthetic oligonucleotide
cccucugcagucggaccuc

SEQ ID NO: 6503 - RNA, 19 nt, Artificial Sequence
  Description of Artificial Sequence: Synthetic oligonucleotide
ucccucugcagucggaccu

SEQ ID NO: 6504 - RNA, 19 nt, Artificial Sequence
  Description of Artificial Sequence: Synthetic oligonucleotide
gucccucugcagucggacc

SEQ ID NO: 6505 - RNA, 19 nt, Artificial Sequence
  Description of Artificial Sequence: Synthetic oligonucleotide
cgucccucugcagucggac

SEQ ID NO: 6506 - RNA, 19 nt, Artificial Sequence
  Description of Artificial Sequence: Synthetic oligonucleotide
ucgucccucugcagucgga

SEQ ID NO: 6507 - RNA, 19 nt, Artificial Sequence
  Description of Artificial Sequence: Synthetic oligonucleotide
gucgucccucugcagucgg

SEQ ID NO: 6508 - RNA, 19 nt, Artificial Sequence
  Description of Artificial Sequence: Synthetic oligonucleotide
agucgucccucugcagucg

SEQ ID NO: 6509 - RNA, 19 nt, Artificial Sequence
  Description of Artificial Sequence: Synthetic oligonucleotide
aagucgucccucugcaguc

SEQ ID NO: 6510 - RNA, 19 nt, Artificial Sequence
  Description of Artificial Sequence: Synthetic oligonucleotide
gaagucgucccucugcagu

SEQ ID NO: 6511 - RNA, 19 nt, Artificial Sequence
  Description of Artificial Sequence: Synthetic oligonucleotide
cgaagucgucccucugcag

SEQ ID NO: 6512 - RNA, 19 nt, Artificial Sequence
  Description of Artificial Sequence: Synthetic oligonucleotide
ucgaagucgucccucugca

SEQ ID NO: 6513 - RNA, 19 nt, Artificial Sequence
  Description of Artificial Sequence: Synthetic oligonucleotide
cucgaagucgucccucugc

SEQ ID NO: 6514 - RNA, 19 nt, Artificial Sequence
  Description of Artificial Sequence: Synthetic oligonucleotide
ucucgaagucgucccucug

SEQ ID NO: 6515 - RNA, 19 nt, Artificial Sequence
  Description of Artificial Sequence: Synthetic oligonucleotide
aucucgaagucgucccucu

SEQ ID NO: 6516 - RNA, 19 nt, Artificial Sequence
  Description of Artificial Sequence: Synthetic oligonucleotide
aaucucgaagucgucccuc

SEQ ID NO: 6517 - RNA, 19 nt, Artificial Sequence
  Description of Artificial Sequence: Synthetic oligonucleotide
gaaucucgaagucgucccu

SEQ ID NO: 6518 - RNA, 19 nt, Artificial Sequence
  Description of Artificial Sequence: Synthetic oligonucleotide
agaaucucgaagucguccc

SEQ ID NO: 6519 - RNA, 19 nt, Artificial Sequence
  Description of Artificial Sequence: Synthetic oligonucleotide
cagaaucucgaagucgucc

SEQ ID NO: 6520 - RNA, 19 nt, Artificial Sequence
  Description of Artificial Sequence: Synthetic oligonucleotide
ucagaaucucgaagucguc

SEQ ID NO: 6521 - RNA, 19 nt, Artificial Sequence
  Description of Artificial Sequence: Synthetic oligonucleotide
uucagaaucucgaagucgu

SEQ ID NO: 6522 - RNA, 19 nt, Artificial Sequence
  Description of Artificial Sequence: Synthetic oligonucleotide
cuucagaaucucgaagucg

SEQ ID NO: 6523 - RNA, 19 nt, Artificial Sequence
  Description of Artificial Sequence: Synthetic oligonucleotide
ccuucagaaucucgaaguc

SEQ ID NO: 6524 - RNA, 19 nt, Artificial Sequence
  Description of Artificial Sequence: Synthetic oligonucleotide
accuucagaaucucgaagu

SEQ ID NO: 6525 - RNA, 19 nt, Artificial Sequence
  Description of Artificial Sequence: Synthetic oligonucleotide
caccuucagaaucucgaag

SEQ ID NO: 6526 - RNA, 19 nt, Artificial Sequence
  Description of Artificial Sequence: Synthetic oligonucleotide
ucaccuucagaaucucgaa

SEQ ID NO: 6527 - RNA, 19 nt, Artificial Sequence
  Description of Artificial Sequence: Synthetic oligonucleotide
aucaccuucagaaucucga

SEQ ID NO: 6528 - RNA, 19 nt, Artificial Sequence
  Description of Artificial Sequence: Synthetic oligonucleotide
gaucaccuucagaaucucg

SEQ ID NO: 6529 - RNA, 19 nt, Artificial Sequence
  Description of Artificial Sequence: Synthetic oligonucleotide
cgaucaccuucagaaucuc

SEQ ID NO: 6530 - RNA, 19 nt, Artificial Sequence
  Description of Artificial Sequence: Synthetic oligonucleotide
ccgaucaccuucagaaucu

SEQ ID NO: 6531 - RNA, 19 nt, Artificial Sequence
  Description of Artificial Sequence: Synthetic oligonucleotide
uccgaucaccuucagaauc

SEQ ID NO: 6532 - RNA, 19 nt, Artificial Sequence
  Description of Artificial Sequence: Synthetic oligonucleotide
guccgaucaccuucagaau

SEQ ID NO: 6533 - RNA, 19 nt, Artificial Sequence
  Description of Artificial Sequence: Synthetic oligonucleotide
cguccgaucaccuucagaa

SEQ ID NO: 6534 - RNA, 19 nt, Artificial Sequence
  Description of Artificial Sequence: Synthetic oligonucleotide
gcguccgaucaccuucaga

SEQ ID NO: 6535 - RNA, 19 nt, Artificial Sequence
  Description of Artificial Sequence: Synthetic oligonucleotide
cgcguccgaucaccuucag

SEQ ID NO: 6536 - RNA, 19 nt, Artificial Sequence
  Description of Artificial Sequence: Synthetic oligonucleotide
ccgcguccgaucaccuuca

SEQ ID NO: 6537 - RNA, 19 nt, Artificial Sequence
  Description of Artificial Sequence: Synthetic oligonucleotide
cccgcguccgaucaccuuc

SEQ ID NO: 6538 - RNA, 19 nt, Artificial Sequence
  Description of Artificial Sequence: Synthetic oligonucleotide
ccccgcguccgaucaccuu

SEQ ID NO: 6539 - RNA, 19 nt, Artificial Sequence
  Description of Artificial Sequence: Synthetic oligonucleotide
gccccgcguccgaucaccu

SEQ ID NO: 6540 - RNA, 19 nt, Artificial Sequence
  Description of Artificial Sequence: Synthetic oligonucleotide
cgccccgcguccgaucacc

SEQ ID NO: 6541 - RNA, 19 nt, Artificial Sequence
  Description of Artificial Sequence: Synthetic oligonucleotide
acgccccgcguccgaucac

SEQ ID NO: 6542 - RNA, 19 nt, Artificial Sequence
  Description of Artificial Sequence: Synthetic oligonucleotide
aacgccccgcguccgauca

SEQ ID NO: 6543 - RNA, 19 nt, Artificial Sequence
  Description of Artificial Sequence: Synthetic oligonucleotide
gaacgccccgcguccgauc

SEQ ID NO: 6544 - RNA, 19 nt, Artificial Sequence
  Description of Artificial Sequence: Synthetic oligonucleotide
ugaacgccccgcguccgau

SEQ ID NO: 6545 - RNA, 19 nt, Artificial Sequence
  Description of Artificial Sequence: Synthetic oligonucleotide
cugaacgccccgcguccga

SEQ ID NO: 6546 - RNA, 19 nt, Artificial Sequence
  Description of Artificial Sequence: Synthetic oligonucleotide
gcugaacgccccgcguccg

SEQ ID NO: 6547 - RNA, 19 nt, Artificial Sequence
  Description of Artificial Sequence: Synthetic oligonucleotide
cgcugaacgccccgcgucc

SEQ ID NO: 6548 - RNA, 19 nt, Artificial Sequence
  Description of Artificial Sequence: Synthetic oligonucleotide
ucgcugaacgccccgcguc

SEQ ID NO: 6549 - RNA, 19 nt, Artificial Sequence
  Description of Artificial Sequence: Synthetic oligonucleotide
cucgcugaacgccccgcgu

SEQ ID NO: 6550 - RNA, 19 nt, Artificial Sequence
  Description of Artificial Sequence: Synthetic oligonucleotide
ccucgcugaacgccccgcg

SEQ ID NO: 6551 - RNA, 19 nt, Artificial Sequence
  Description of Artificial Sequence: Synthetic oligonucleotide
accucgcugaacgccccgc

SEQ ID NO: 6552 - RNA, 19 nt, Artificial Sequence
  Description of Artificial Sequence: Synthetic oligonucleotide
uaccucgcugaacgccccg

SEQ ID NO: 6553 - RNA, 19 nt, Artificial Sequence
  Description of Artificial Sequence: Synthetic oligonucleotide
cuaccucgcugaacgcccc

SEQ ID NO: 6554 - RNA, 19 nt, Artificial Sequence
  Description of Artificial Sequence: Synthetic oligonucleotide
gcuaccucgcugaacgccc

SEQ ID NO: 6555 - RNA, 19 nt, Artificial Sequence
  Description of Artificial Sequence: Synthetic oligonucleotide
cgcuaccucgcugaacgcc

SEQ ID NO: 6556 - RNA, 19 nt, Artificial Sequence
  Description of Artificial Sequence: Synthetic oligonucleotide
ccgcuaccucgcugaacgc

SEQ ID NO: 6557 - RNA, 19 nt, Artificial Sequence
  Description of Artificial Sequence: Synthetic oligonucleotide
accgcuaccucgcugaacg

SEQ ID NO: 6558 - RNA, 19 nt, Artificial Sequence
  Description of Artificial Sequence: Synthetic oligonucleotide
uaccgcuaccucgcugaac

SEQ ID NO: 6559 - RNA, 19 nt, Artificial Sequence
  Description of Artificial Sequence: Synthetic oligonucleotide
cuaccgcuaccucgcugaa

SEQ ID NO: 6560 - RNA, 19 nt, Artificial Sequence
  Description of Artificial Sequence: Synthetic oligonucleotide
acuaccgcuaccucgcuga

SEQ ID NO: 6561 - RNA, 19 nt, Artificial Sequence
  Description of Artificial Sequence: Synthetic oligonucleotide
cacuaccgcuaccucgcug

SEQ ID NO: 6562 - RNA, 19 nt, Artificial Sequence
  Description of Artificial Sequence: Synthetic oligonucleotide
ucacuaccgcuaccucgcu

SEQ ID NO: 6563 - RNA, 19 nt, Artificial Sequence
  Description of Artificial Sequence: Synthetic oligonucleotide
uucacuaccgcuaccucgc

SEQ ID NO: 6564 - RNA, 19 nt, Artificial Sequence
  Description of Artificial Sequence: Synthetic oligonucleotide
cuucacuaccgcuaccucg

SEQ ID NO: 6565 - RNA, 19 nt, Artificial Sequence
  Description of Artificial Sequence: Synthetic oligonucleotide
ucuucacuaccgcuaccuc

SEQ ID NO: 6566 - RNA, 19 nt, Artificial Sequence
  Description of Artificial Sequence: Synthetic oligonucleotide
aucuucacuaccgcuaccu

SEQ ID NO: 6567 - RNA, 19 nt, Artificial Sequence
  Description of Artificial Sequence: Synthetic oligonucleotide
caucuucacuaccgcuacc

SEQ ID NO: 6568 - RNA, 19 nt, Artificial Sequence
  Description of Artificial Sequence: Synthetic oligonucleotide
ucaucuucacuaccgcuac

SEQ ID NO: 6569 - RNA, 19 nt, Artificial Sequence
  Description of Artificial Sequence: Synthetic oligonucleotide
uucaucuucacuaccgcua

SEQ ID NO: 6570 - RNA, 19 nt, Artificial Sequence
  Description of Artificial Sequence: Synthetic oligonucleotide
cuucaucuucacuaccgcu

SEQ ID NO: 6571 - RNA, 19 nt, Artificial Sequence
  Description of Artificial Sequence: Synthetic oligonucleotide
gcuucaucuucacuaccgc

SEQ ID NO: 6572 - RNA, 19 nt, Artificial Sequence
  Description of Artificial Sequence: Synthetic oligonucleotide
ugcuucaucuucacuaccg

SEQ ID NO: 6573 - RNA, 19 nt, Artificial Sequence
  Description of Artificial Sequence: Synthetic oligonucleotide
cugcuucaucuucacuacc

SEQ ID NO: 6574 - RNA, 19 nt, Artificial Sequence
  Description of Artificial Sequence: Synthetic oligonucleotide
ucugcuucaucuucacuac

SEQ ID NO: 6575 - RNA, 19 nt, Artificial Sequence
  Description of Artificial Sequence: Synthetic oligonucleotide
gucugcuucaucuucacua

SEQ ID NO: 6576 - RNA, 19 nt, Artificial Sequence
  Description of Artificial Sequence: Synthetic oligonucleotide
cgucugcuucaucuucacu

SEQ ID NO: 6577 - RNA, 19 nt, Artificial Sequence
  Description of Artificial Sequence: Synthetic oligonucleotide
ccgucugcuucaucuucac

SEQ ID NO: 6578 - RNA, 19 nt, Artificial Sequence
  Description of Artificial Sequence: Synthetic oligonucleotide
cccgucugcuucaucuuca

SEQ ID NO: 6579 - RNA, 19 nt, Artificial Sequence
  Description of Artificial Sequence: Synthetic oligonucleotide
gcccgucugcuucaucuuc

SEQ ID NO: 6580 - RNA, 19 nt, Artificial Sequence
  Description of Artificial Sequence: Synthetic oligonucleotide
ggcccgucugcuucaucuu

SEQ ID NO: 6581 - RNA, 19 nt, Artificial Sequence
  Description of Artificial Sequence: Synthetic oligonucleotide
uggcccgucugcuucaucu

SEQ ID NO: 6582 - RNA, 19 nt, Artificial Sequence
  Description of Artificial Sequence: Synthetic oligonucleotide
cuggcccgucugcuucauc

SEQ ID NO: 6583 - RNA, 19 nt, Artificial Sequence
  Description of Artificial Sequence: Synthetic oligonucleotide
ccuggcccgucugcuucau

SEQ ID NO: 6584 - RNA, 19 nt, Artificial Sequence
  Description of Artificial Sequence: Synthetic oligonucleotide
accuggcccgucugcuuca

SEQ ID NO: 6585 - RNA, 19 nt, Artificial Sequence
  Description of Artificial Sequence: Synthetic oligonucleotide
caccuggcccgucugcuuc

SEQ ID NO: 6586 - RNA, 19 nt, Artificial Sequence
  Description of Artificial Sequence: Synthetic oligonucleotide
acaccuggcccgucugcuu

SEQ ID NO: 6587 - RNA, 19 nt, Artificial Sequence
  Description of Artificial Sequence: Synthetic oligonucleotide
uacaccuggcccgucugcu

SEQ ID NO: 6588 - RNA, 19 nt, Artificial Sequence
  Description of Artificial Sequence: Synthetic oligonucleotide
auacaccuggcccgucugc

SEQ ID NO: 6589 - RNA, 19 nt, Artificial Sequence
  Description of Artificial Sequence: Synthetic oligonucleotide
cauacaccuggcccgucug

SEQ ID NO: 6590 - RNA, 19 nt, Artificial Sequence
  Description of Artificial Sequence: Synthetic oligonucleotide
gcauacaccuggcccgucu

SEQ ID NO: 6591 - RNA, 19 nt, Artificial Sequence
  Description of Artificial Sequence: Synthetic oligonucleotide
ggcauacaccuggcccguc

SEQ ID NO: 6592 - RNA, 19 nt, Artificial Sequence
  Description of Artificial Sequence: Synthetic oligonucleotide
uggcauacaccuggcccgu

SEQ ID NO: 6593 - RNA, 19 nt, Artificial Sequence
  Description of Artificial Sequence: Synthetic oligonucleotide
auggcauacaccuggcccg

SEQ ID NO: 6594 - RNA, 19 nt, Artificial Sequence
  Description of Artificial Sequence: Synthetic oligonucleotide
cauggcauacaccuggccc

SEQ ID NO: 6595 - RNA, 19 nt, Artificial Sequence
  Description of Artificial Sequence: Synthetic oligonucleotide
ucauggcauacaccuggcc

SEQ ID NO: 6596 - RNA, 19 nt, Artificial Sequence
  Description of Artificial Sequence: Synthetic oligonucleotide
uucauggcauacaccuggc

SEQ ID NO: 6597 - RNA, 19 nt, Artificial Sequence
  Description of Artificial Sequence: Synthetic oligonucleotide
cuucauggcauacaccugg

SEQ ID NO: 6598 - RNA, 19 nt, Artificial Sequence
  Description of Artificial Sequence: Synthetic oligonucleotide
ucuucauggcauacaccug

SEQ ID NO: 6599 - RNA, 19 nt, Artificial Sequence
  Description of Artificial Sequence: Synthetic oligonucleotide
aucuucauggcauacaccu

SEQ ID NO: 6600 - RNA, 19 nt, Artificial Sequence
  Description of Artificial Sequence: Synthetic oligonucleotide
gaucuucauggcauacacc

SEQ ID NO: 6601 - RNA, 19 nt, Artificial Sequence
  Description of Artificial Sequence: Synthetic oligonucleotide
ugaucuucauggcauacac

SEQ ID NO: 6602 - RNA, 19 nt, Artificial Sequence
  Description of Artificial Sequence: Synthetic oligonucleotide
augaucuucauggcauaca

SEQ ID NO: 6603 - RNA, 19 nt, Artificial Sequence
  Description of Artificial Sequence: Synthetic oligonucleotide
caugaucuucauggcauac

SEQ ID NO: 6604 - RNA, 19 nt, Artificial Sequence
  Description of Artificial Sequence: Synthetic oligonucleotide
ucaugaucuucauggcaua

SEQ ID NO: 6605 - RNA, 19 nt, Artificial Sequence
  Description of Artificial Sequence: Synthetic oligonucleotide
uucaugaucuucauggcau

SEQ ID NO: 6606 - RNA, 19 nt, Artificial Sequence
  Description of Artificial Sequence: Synthetic oligonucleotide
guucaugaucuucauggca

SEQ ID NO: 6607 - RNA, 19 nt, Artificial Sequence
  Description of Artificial Sequence: Synthetic oligonucleotide
uguucaugaucuucauggc

SEQ ID NO: 6608 - RNA, 19 nt, Artificial Sequence
  Description of Artificial Sequence: Synthetic oligonucleotide
uuguucaugaucuucaugg

SEQ ID NO: 6609 - RNA, 19 nt, Artificial Sequence
  Description of Artificial Sequence: Synthetic oligonucleotide
cuuguucaugaucuucaug

SEQ ID NO: 6610 - RNA, 19 nt, Artificial Sequence
  Description of Artificial Sequence: Synthetic oligonucleotide
acuuguucaugaucuucau

SEQ ID NO: 6611 - RNA, 19 nt, Artificial Sequence
  Description of Artificial Sequence: Synthetic oligonucleotide
cacuuguucaugaucuuca

SEQ ID NO: 6612 - RNA, 19 nt, Artificial Sequence
  Description of Artificial Sequence: Synthetic oligonucleotide
ccacuuguucaugaucuuc

SEQ ID NO: 6613 - RNA, 19 nt, Artificial Sequence
  Description of Artificial Sequence: Synthetic oligonucleotide
cccacuuguucaugaucuu

SEQ ID NO: 6614 - RNA, 19 nt, Artificial Sequence
  Description of Artificial Sequence: Synthetic oligonucleotide
ucccacuuguucaugaucu

SEQ ID NO: 6615 - RNA, 19 nt, Artificial Sequence
  Description of Artificial Sequence: Synthetic oligonucleotide
gucccacuuguucaugauc

SEQ ID NO: 6616 - RNA, 19 nt, Artificial Sequence
  Description of Artificial Sequence: Synthetic oligonucleotide
ugucccacuuguucaugau

SEQ ID NO: 6617 - RNA, 19 nt, Artificial Sequence
  Description of Artificial Sequence: Synthetic oligonucleotide
augucccacuuguucauga

SEQ ID NO: 6618 - RNA, 19 nt, Artificial Sequence
  Description of Artificial Sequence: Synthetic oligonucleotide
caugucccacuuguucaug

SEQ ID NO: 6619 - RNA, 19 nt, Artificial Sequence
  Description of Artificial Sequence: Synthetic oligonucleotide
gcaugucccacuuguucau

SEQ ID NO: 6620 - RNA, 19 nt, Artificial Sequence
  Description of Artificial Sequence: Synthetic oligonucleotide
agcaugucccacuuguuca

SEQ ID NO: 6621 - RNA, 19 nt, Artificial Sequence
  Description of Artificial Sequence: Synthetic oligonucleotide
cagcaugucccacuuguuc

SEQ ID NO: 6622 - RNA, 19 nt, Artificial Sequence
  Description of Artificial Sequence: Synthetic oligonucleotide
ucagcaugucccacuuguu

SEQ ID NO: 6623 - RNA, 19 nt, Artificial Sequence
  Description of Artificial Sequence: Synthetic oligonucleotide
uucagcaugucccacuugu

SEQ ID NO: 6624 - RNA, 19 nt, Artificial Sequence
  Description of Artificial Sequence: Synthetic oligonucleotide
cuucagcaugucccacuug

SEQ ID NO: 6625 - RNA, 19 nt, Artificial Sequence
  Description of Artificial Sequence: Synthetic oligonucleotide
ucuucagcaugucccacuu

SEQ ID NO: 6626 - RNA, 19 nt, Artificial Sequence
  Description of Artificial Sequence: Synthetic oligonucleotide
cucuucagcaugucccacu

SEQ ID NO: 6627 - RNA, 19 nt, Artificial Sequence
  Description of Artificial Sequence: Synthetic oligonucleotide
ccucuucagcaugucccac

SEQ ID NO: 6628 - RNA, 19 nt, Artificial Sequence
  Description of Artificial Sequence: Synthetic oligonucleotide
cccucuucagcauguccca

SEQ ID NO: 6629 - RNA, 19 nt, Artificial Sequence
  Description of Artificial Sequence: Synthetic oligonucleotide
ccccucuucagcauguccc

SEQ ID NO: 6630 - RNA, 19 nt, Artificial Sequence
  Description of Artificial Sequence: Synthetic oligonucleotide
gccccucuucagcaugucc

SEQ ID NO: 6631 - RNA, 19 nt, Artificial Sequence
  Description of Artificial Sequence: Synthetic oligonucleotide
cgccccucuucagcauguc

SEQ ID NO: 6632 - RNA, 19 nt, Artificial Sequence
  Description of Artificial Sequence: Synthetic oligonucleotide
ucgccccucuucagcaugu

SEQ ID NO: 6633 - RNA, 19 nt, Artificial Sequence
  Description of Artificial Sequence: Synthetic oligonucleotide
cucgccccucuucagcaug

SEQ ID NO: 6634 - RNA, 19 nt, Artificial Sequence
  Description of Artificial Sequence: Synthetic oligonucleotide
ccucgccccucuucagcau

SEQ ID NO: 6635 - RNA, 19 nt, Artificial Sequence
  Description of Artificial Sequence: Synthetic oligonucleotide
accucgccccucuucagca

SEQ ID NO: 6636 - RNA, 19 nt, Artificial Sequence
  Description of Artificial Sequence: Synthetic oligonucleotide
caccucgccccucuucagc

SEQ ID NO: 6637 - RNA, 19 nt, Artificial Sequence
  Description of Artificial Sequence: Synthetic oligonucleotide
acaccucgccccucuucag

SEQ ID NO: 6638 - RNA, 19 nt, Artificial Sequence
  Description of Artificial Sequence: Synthetic oligonucleotide
gacaccucgccccucuuca

SEQ ID NO: 6639 - RNA, 19 nt, Artificial Sequence
  Description of Artificial Sequence: Synthetic oligonucleotide
cgacaccucgccccucuuc

SEQ ID NO: 6640 - RNA, 19 nt, Artificial Sequence
  Description of Artificial Sequence: Synthetic oligonucleotide
acgacaccucgccccucuu

SEQ ID NO: 6641 - RNA, 19 nt, Artificial Sequence
  Description of Artificial Sequence: Synthetic oligonucleotide
cacgacaccucgccccucu

SEQ ID NO: 6642 - RNA, 19 nt, Artificial Sequence
  Description of Artificial Sequence: Synthetic oligonucleotide
gcacgacaccucgccccuc

SEQ ID NO: 6643 - RNA, 19 nt, Artificial Sequence
  Description of Artificial Sequence: Synthetic oligonucleotide
agcacgacaccucgccccu

SEQ ID NO: 6644 - RNA, 19 nt, Artificial Sequence
  Description of Artificial Sequence: Synthetic oligonucleotide
aagcacgacaccucgcccc

SEQ ID NO: 6645 - RNA, 19 nt, Artificial Sequence
  Description of Artificial Sequence: Synthetic oligonucleotide
gaagcacgacaccucgccc

SEQ ID NO: 6646 - RNA, 19 nt, Artificial Sequence
  Description of Artificial Sequence: Synthetic oligonucleotide
ggaagcacgacaccucgcc

SEQ ID NO: 6647 - RNA, 19 nt, Artificial Sequence
  Description of Artificial Sequence: Synthetic oligonucleotide
cggaagcacgacaccucgc

SEQ ID NO: 6648 - RNA, 19 nt, Artificial Sequence
  Description of Artificial Sequence: Synthetic oligonucleotide
acggaagcacgacaccucg

SEQ ID NO: 6649 - RNA, 19 nt, Artificial Sequence
  Description of Artificial Sequence: Synthetic oligonucleotide
cacggaagcacgacaccuc

SEQ ID NO: 6650 - RNA, 19 nt, Artificial Sequence
  Description of Artificial Sequence: Synthetic oligonucleotide
ucacggaagcacgacaccu

SEQ ID NO: 6651 - RNA, 19 nt, Artificial Sequence
  Description of Artificial Sequence: Synthetic oligonucleotide
cucacggaagcacgacacc

SEQ ID NO: 6652 - RNA, 19 nt, Artificial Sequence
  Description of Artificial Sequence: Synthetic oligonucleotide
ccucacggaagcacgacac

SEQ ID NO: 6653 - RNA, 19 nt, Artificial Sequence
  Description of Artificial Sequence: Synthetic oligonucleotide
uccucacggaagcacgaca

SEQ ID NO: 6654 - RNA, 19 nt, Artificial Sequence
  Description of Artificial Sequence: Synthetic oligonucleotide
cuccucacggaagcacgac

SEQ ID NO: 6655 - RNA, 19 nt, Artificial Sequence
  Description of Artificial Sequence: Synthetic oligonucleotide
ucuccucacggaagcacga

SEQ ID NO: 6656 - RNA, 19 nt, Artificial Sequence
  Description of Artificial Sequence: Synthetic oligonucleotide
cucuccucacggaagcacg

SEQ ID NO: 6657 - RNA, 19 nt, Artificial Sequence
  Description of Artificial Sequence: Synthetic oligonucleotide
ccucuccucacggaagcac

SEQ ID NO: 6658 - RNA, 19 nt, Artificial Sequence
  Description of Artificial Sequence: Synthetic oligonucleotide
cccucuccucacggaagca

SEQ ID NO: 6659 - RNA, 19 nt, Artificial Sequence
  Description of Artificial Sequence: Synthetic oligonucleotide
ucccucuccucacggaagc

SEQ ID NO: 6660 - RNA, 19 nt, Artificial Sequence
  Description of Artificial Sequence: Synthetic oligonucleotide
gucccucuccucacggaag

SEQ ID NO: 6661 - RNA, 19 nt, Artificial Sequence
  Description of Artificial Sequence: Synthetic oligonucleotide
cgucccucuccucacggaa

SEQ ID NO: 6662 - RNA, 19 nt, Artificial Sequence
  Description of Artificial Sequence: Synthetic oligonucleotide
acgucccucuccucacgga

SEQ ID NO: 6663 - RNA, 19 nt, Artificial Sequence
  Description of Artificial Sequence: Synthetic oligonucleotide
cacgucccucuccucacgg

SEQ ID NO: 6664 - RNA, 19 nt, Artificial Sequence
  Description of Artificial Sequence: Synthetic oligonucleotide
acacgucccucuccucacg

SEQ ID NO: 6665 - RNA, 19 nt, Artificial Sequence
  Description of Artificial Sequence: Synthetic oligonucleotide
aacacgucccucuccucac

SEQ ID NO: 6666 - RNA, 19 nt, Artificial Sequence
  Description of Artificial Sequence: Synthetic oligonucleotide
caacacgucccucuccuca

SEQ ID NO: 6667 - RNA, 19 nt, Artificial Sequence
  Description of Artificial Sequence: Synthetic oligonucleotide
ccaacacgucccucuccuc

SEQ ID NO: 6668 - RNA, 19 nt, Artificial Sequence
  Description of Artificial Sequence: Synthetic oligonucleotide
accaacacgucccucuccu

SEQ ID NO: 6669 - RNA, 19 nt, Artificial Sequence
  Description of Artificial Sequence: Synthetic oligonucleotide
caccaacacgucccucucc

SEQ ID NO: 6670 - RNA, 19 nt, Artificial Sequence
  Description of Artificial Sequence: Synthetic oligonucleotide
ucaccaacacgucccucuc

SEQ ID NO: 6671 - RNA, 19 nt, Artificial Sequence
  Description of Artificial Sequence: Synthetic oligonucleotide
uucaccaacacgucccucu

SEQ ID NO: 6672 - RNA, 19 nt, Artificial Sequence
  Description of Artificial Sequence: Synthetic oligonucleotide
auucaccaacacgucccuc

SEQ ID NO: 6673 - RNA, 19 nt, Artificial Sequence
  Description of Artificial Sequence: Synthetic oligonucleotide
cauucaccaacacgucccu

SEQ ID NO: 6674 - RNA, 19 nt, Artificial Sequence
  Description of Artificial Sequence: Synthetic oligonucleotide
ccauucaccaacacguccc

SEQ ID NO: 6675 - RNA, 19 nt, Artificial Sequence
  Description of Artificial Sequence: Synthetic oligonucleotide
cccauucaccaacacgucc

SEQ ID NO: 6676 - RNA, 19 nt, Artificial Sequence
  Description of Artificial Sequence: Synthetic oligonucleotide
ccccauucaccaacacguc

SEQ ID NO: 6677 - RNA, 19 nt, Artificial Sequence
  Description of Artificial Sequence: Synthetic oligonucleotide
uccccauucaccaacacgu

SEQ ID NO: 6678 - RNA, 19 nt, Artificial Sequence
  Description of Artificial Sequence: Synthetic oligonucleotide
guccccauucaccaacacg

SEQ ID NO: 6679 - RNA, 19 nt, Artificial Sequence
  Description of Artificial Sequence: Synthetic oligonucleotide
gguccccauucaccaacac

SEQ ID NO: 6680 - RNA, 19 nt, Artificial Sequence
  Description of Artificial Sequence: Synthetic oligonucleotide
cgguccccauucaccaaca

SEQ ID NO: 6681 - RNA, 19 nt, Artificial Sequence
  Description of Artificial Sequence: Synthetic oligonucleotide
ccgguccccauucaccaac

SEQ ID NO: 6682 - RNA, 19 nt, Artificial Sequence
  Description of Artificial Sequence: Synthetic oligonucleotide
gccgguccccauucaccaa

SEQ ID NO: 6683 - RNA, 19 nt, Artificial Sequence
  Description of Artificial Sequence: Synthetic oligonucleotide
cgccgguccccauucacca

SEQ ID NO: 6684 - RNA, 19 nt, Artificial Sequence
  Description of Artificial Sequence: Synthetic oligonucleotide
ccgccgguccccauucacc

SEQ ID NO: 6685 - RNA, 19 nt, Artificial Sequence
  Description of Artificial Sequence: Synthetic oligonucleotide
accgccgguccccauucac

SEQ ID NO: 6686 - RNA, 19 nt, Artificial Sequence
  Description of Artificial Sequence: Synthetic oligonucleotide
caccgccgguccccauuca

SEQ ID NO: 6687 - RNA, 19 nt, Artificial Sequence
  Description of Artificial Sequence: Synthetic oligonucleotide
ccaccgccgguccccauuc

SEQ ID NO: 6688 - RNA, 19 nt, Artificial Sequence
  Description of Artificial Sequence: Synthetic oligonucleotide
uccaccgccgguccccauu

SEQ ID NO: 6689 - RNA, 19 nt, Artificial Sequence
  Description of Artificial Sequence: Synthetic oligonucleotide
auccaccgccgguccccau

SEQ ID NO: 6690 - RNA, 19 nt, Artificial Sequence
  Description of Artificial Sequence: Synthetic oligonucleotide
gauccaccgccggucccca

SEQ ID NO: 6691 - RNA, 19 nt, Artificial Sequence
  Description of Artificial Sequence: Synthetic oligonucleotide
ugauccaccgccggucccc

SEQ ID NO: 6692 - RNA, 19 nt, Artificial Sequence
  Description of Artificial Sequence: Synthetic oligonucleotide
gugauccaccgccgguccc

SEQ ID NO: 6693 - RNA, 19 nt, Artificial Sequence
  Description of Artificial Sequence: Synthetic oligonucleotide
cgugauccaccgccggucc

SEQ ID NO: 6694 - RNA, 19 nt, Artificial Sequence
  Description of Artificial Sequence: Synthetic oligonucleotide
gcgugauccaccgccgguc

SEQ ID NO: 6695 - RNA, 19 nt, Artificial Sequence
  Description of Artificial Sequence: Synthetic oligonucleotide
ugcgugauccaccgccggu

SEQ ID NO: 6696 - RNA, 19 nt, Artificial Sequence
  Description of Artificial Sequence: Synthetic oligonucleotide
cugcgugauccaccgccgg

SEQ ID NO: 6697 - RNA, 19 nt, Artificial Sequence
  Description of Artificial Sequence: Synthetic oligonucleotide
gcugcgugauccaccgccg

SEQ ID NO: 6698 - RNA, 19 nt, Artificial Sequence
  Description of Artificial Sequence: Synthetic oligonucleotide
agcugcgugauccaccgcc

SEQ ID NO: 6699 - RNA, 19 nt, Artificial Sequence
  Description of Artificial Sequence: Synthetic oligonucleotide
cagcugcgugauccaccgc

SEQ ID NO: 6700 - RNA, 19 nt, Artificial Sequence
  Description of Artificial Sequence: Synthetic oligonucleotide
gcagcugcgugauccaccg

SEQ ID NO: 6701 - RNA, 19 nt, Artificial Sequence
  Description of Artificial Sequence: Synthetic oligonucleotide
ugcagcugcgugauccacc

SEQ ID NO: 6702 - RNA, 19 nt, Artificial Sequence
  Description of Artificial Sequence: Synthetic oligonucleotide
gugcagcugcgugauccac

SEQ ID NO: 6703 - RNA, 19 nt, Artificial Sequence
  Description of Artificial Sequence: Synthetic oligonucleotide
agugcagcugcgugaucca

SEQ ID NO: 6704 - RNA, 19 nt, Artificial Sequence
  Description of Artificial Sequence: Synthetic oligonucleotide
aagugcagcugcgugaucc

SEQ ID NO: 6705 - RNA, 19 nt, Artificial Sequence
  Description of Artificial Sequence: Synthetic oligonucleotide
gaagugcagcugcgugauc

SEQ ID NO: 6706 - RNA, 19 nt, Artificial Sequence
  Description of Artificial Sequence: Synthetic oligonucleotide
cgaagugcagcugcgugau

SEQ ID NO: 6707 - RNA, 19 nt, Artificial Sequence
  Description of Artificial Sequence: Synthetic oligonucleotide
gcgaagugcagcugcguga

SEQ ID NO: 6708 - RNA, 19 nt, Artificial Sequence
  Description of Artificial Sequence: Synthetic oligonucleotide
ggcgaagugcagcugcgug

SEQ ID NO: 6709 - RNA, 19 nt, Artificial Sequence
  Description of Artificial Sequence: Synthetic oligonucleotide
aggcgaagugcagcugcgu

SEQ ID NO: 6710 - RNA, 19 nt, Artificial Sequence
  Description of Artificial Sequence: Synthetic oligonucleotide
aaggcgaagugcagcugcg

SEQ ID NO: 6711 - RNA, 19 nt, Artificial Sequence
  Description of Artificial Sequence: Synthetic oligonucleotide
gaaggcgaagugcagcugc

SEQ ID NO: 6712 - RNA, 19 nt, Artificial Sequence
  Description of Artificial Sequence: Synthetic oligonucleotide
ggaaggcgaagugcagcug

SEQ ID NO: 6713 - RNA, 19 nt, Artificial Sequence
  Description of Artificial Sequence: Synthetic oligonucleotide
uggaaggcgaagugcagcu

SEQ ID NO: 6714 - RNA, 19 nt, Artificial Sequence
  Description of Artificial Sequence: Synthetic oligonucleotide
cuggaaggcgaagugcagc

SEQ ID NO: 6715 - RNA, 19 nt, Artificial Sequence
  Description of Artificial Sequence: Synthetic oligonucleotide
ccuggaaggcgaagugcag

SEQ ID NO: 6716 - RNA, 19 nt, Artificial Sequence
  Description of Artificial Sequence: Synthetic oligonucleotide
uccuggaaggcgaagugca

SEQ ID NO: 6717 - RNA, 19 nt, Artificial Sequence
  Description of Artificial Sequence: Synthetic oligonucleotide
auccuggaaggcgaagugc

SEQ ID NO: 6718 - RNA, 19 nt, Artificial Sequence
  Description of Artificial Sequence: Synthetic oligonucleotide
cauccuggaaggcgaagug

SEQ ID NO: 6719 - RNA, 19 nt, Artificial Sequence
  Description of Artificial Sequence: Synthetic oligonucleotide
ucauccuggaaggcgaagu

SEQ ID NO: 6720 - RNA, 19 nt, Artificial Sequence
  Description of Artificial Sequence: Synthetic oligonucleotide
cucauccuggaaggcgaag

SEQ ID NO: 6721 - RNA, 19 nt, Artificial Sequence
  Description of Artificial Sequence: Synthetic oligonucleotide
ucucauccuggaaggcgaa

SEQ ID NO: 6722 - RNA, 19 nt, Artificial Sequence
  Description of Artificial Sequence: Synthetic oligonucleotide
uucucauccuggaaggcga

SEQ ID NO: 6723 - RNA, 19 nt, Artificial Sequence
  Description of Artificial Sequence: Synthetic oligonucleotide
guucucauccuggaaggcg

SEQ ID NO: 6724 - RNA, 19 nt, Artificial Sequence
  Description of Artificial Sequence: Synthetic oligonucleotide
aguucucauccuggaaggc

SEQ ID NO: 6725 - RNA, 19 nt, Artificial Sequence
  Description of Artificial Sequence: Synthetic oligonucleotide
uaguucucauccuggaagg

SEQ ID NO: 6726 - RNA, 19 nt, Artificial Sequence
  Description of Artificial Sequence: Synthetic oligonucleotide
guaguucucauccuggaag

SEQ ID NO: 6727 - RNA, 19 nt, Artificial Sequence
  Description of Artificial Sequence: Synthetic oligonucleotide
gguaguucucauccuggaa

SEQ ID NO: 6728 - RNA, 19 nt, Artificial Sequence
  Description of Artificial Sequence: Synthetic oligonucleotide
agguaguucucauccugga

SEQ ID NO: 6729 - RNA, 19 nt, Artificial Sequence
  Description of Artificial Sequence: Synthetic oligonucleotide
cagguaguucucauccugg

SEQ ID NO: 6730 - RNA, 19 nt, Artificial Sequence
  Description of Artificial Sequence: Synthetic oligonucleotide
acagguaguucucauccug

SEQ ID NO: 6731 - RNA, 19 nt, Artificial Sequence
  Description of Artificial Sequence: Synthetic oligonucleotide
uacagguaguucucauccu

SEQ ID NO: 6732 - RNA, 19 nt, Artificial Sequence
  Description of Artificial Sequence: Synthetic oligonucleotide
guacagguaguucucaucc

SEQ ID NO: 6733 - RNA, 19 nt, Artificial Sequence
  Description of Artificial Sequence: Synthetic oligonucleotide
gguacagguaguucucauc

SEQ ID NO: 6734 - RNA, 19 nt, Artificial Sequence
  Description of Artificial Sequence: Synthetic oligonucleotide
agguacagguaguucucau

SEQ ID NO: 6735 - RNA, 19 nt, Artificial Sequence
  Description of Artificial Sequence: Synthetic oligonucleotide
cagguacagguaguucuca

SEQ ID NO: 6736 - RNA, 19 nt, Artificial Sequence
  Description of Artificial Sequence: Synthetic oligonucleotide
ccagguacagguaguucuc

SEQ ID NO: 6737 - RNA, 19 nt, Artificial Sequence
  Description of Artificial Sequence: Synthetic oligonucleotide
accagguacagguaguucu

SEQ ID NO: 6738 - RNA, 19 nt, Artificial Sequence
  Description of Artificial Sequence: Synthetic oligonucleotide
gaccagguacagguaguuc

SEQ ID NO: 6739 - RNA, 19 nt, Artificial Sequence
  Description of Artificial Sequence: Synthetic oligonucleotide
ugaccagguacagguaguu

SEQ ID NO: 6740 - RNA, 19 nt, Artificial Sequence
  Description of Artificial Sequence: Synthetic oligonucleotide
augaccagguacagguagu

SEQ ID NO: 6741 - RNA, 19 nt, Artificial Sequence
  Description of Artificial Sequence: Synthetic oligonucleotide
caugaccagguacagguag

SEQ ID NO: 6742 - RNA, 19 nt, Artificial Sequence
  Description of Artificial Sequence: Synthetic oligonucleotide
ccaugaccagguacaggua

SEQ ID NO: 6743 - RNA, 19 nt, Artificial Sequence
  Description of Artificial Sequence: Synthetic oligonucleotide
uccaugaccagguacaggu

SEQ ID NO: 6744 - RNA, 19 nt, Artificial Sequence
  Description of Artificial Sequence: Synthetic oligonucleotide
cuccaugaccagguacagg

SEQ ID NO: 6745 - RNA, 19 nt, Artificial Sequence
  Description of Artificial Sequence: Synthetic oligonucleotide
acuccaugaccagguacag

SEQ ID NO: 6746 - RNA, 19 nt, Artificial Sequence
  Description of Artificial Sequence: Synthetic oligonucleotide
uacuccaugaccagguaca

SEQ ID NO: 6747 - RNA, 19 nt, Artificial Sequence
  Description of Artificial Sequence: Synthetic oligonucleotide
auacuccaugaccagguac

SEQ ID NO: 6748 - RNA, 19 nt, Artificial Sequence
  Description of Artificial Sequence: Synthetic oligonucleotide
aauacuccaugaccaggua

SEQ ID NO: 6749 - RNA, 19 nt, Artificial Sequence
  Description of Artificial Sequence: Synthetic oligonucleotide
uaauacuccaugaccaggu

SEQ ID NO: 6750 - RNA, 19 nt, Artificial Sequence
  Description of Artificial Sequence: Synthetic oligonucleotide
guaauacuccaugaccagg

SEQ ID NO: 6751 - RNA, 19 nt, Artificial Sequence
  Description of Artificial Sequence: Synthetic oligonucleotide
cguaauacuccaugaccag

SEQ ID NO: 6752 - RNA, 19 nt, Artificial Sequence
  Description of Artificial Sequence: Synthetic oligonucleotide
acguaauacuccaugacca

SEQ ID NO: 6753 - RNA, 19 nt, Artificial Sequence
  Description of Artificial Sequence: Synthetic oligonucleotide
cacguaauacuccaugacc

SEQ ID NO: 6754 - RNA, 19 nt, Artificial Sequence
  Description of Artificial Sequence: Synthetic oligonucleotide
ccacguaauacuccaugac

SEQ ID NO: 6755 - RNA, 19 nt, Artificial Sequence
  Description of Artificial Sequence: Synthetic oligonucleotide
cccacguaauacuccauga

SEQ ID NO: 6756 - RNA, 19 nt, Artificial Sequence
  Description of Artificial Sequence: Synthetic oligonucleotide
gcccacguaauacuccaug

SEQ ID NO: 6757 - RNA, 19 nt, Artificial Sequence
  Description of Artificial Sequence: Synthetic oligonucleotide
cgcccacguaauacuccau

SEQ ID NO: 6758 - RNA, 19 nt, Artificial Sequence
  Description of Artificial Sequence: Synthetic oligonucleotide
ccgcccacguaauacucca

SEQ ID NO: 6759 - RNA, 19 nt, Artificial Sequence
  Description of Artificial Sequence: Synthetic oligonucleotide
cccgcccacguaauacucc

SEQ ID NO: 6760 - RNA, 19 nt, Artificial Sequence
  Description of Artificial Sequence: Synthetic oligonucleotide
ccccgcccacguaauacuc

SEQ ID NO: 6761 - RNA, 19 nt, Artificial Sequence
  Description of Artificial Sequence: Synthetic oligonucleotide
uccccgcccacguaauacu

SEQ ID NO: 6762 - RNA, 19 nt, Artificial Sequence
  Description of Artificial Sequence: Synthetic oligonucleotide
guccccgcccacguaauac

SEQ ID NO: 6763 - RNA, 19 nt, Artificial Sequence
  Description of Artificial Sequence: Synthetic oligonucleotide
gguccccgcccacguaaua

SEQ ID NO: 6764 - RNA, 19 nt, Artificial Sequence
  Description of Artificial Sequence: Synthetic oligonucleotide
agguccccgcccacguaau

SEQ ID NO: 6765 - RNA, 19 nt, Artificial Sequence
  Description of Artificial Sequence: Synthetic oligonucleotide
cagguccccgcccacguaa

SEQ ID NO: 6766 - RNA, 19 nt, Artificial Sequence
  Description of Artificial Sequence: Synthetic oligonucleotide
gcagguccccgcccacgua

SEQ ID NO: 6767 - RNA, 19 nt, Artificial Sequence
  Description of Artificial Sequence: Synthetic oligonucleotide
agcagguccccgcccacgu

SEQ ID NO: 6768 - RNA, 19 nt, Artificial Sequence
  Description of Artificial Sequence: Synthetic oligonucleotide
cagcagguccccgcccacg

SEQ ID NO: 6769 - RNA, 19 nt, Artificial Sequence
  Description of Artificial Sequence: Synthetic oligonucleotide
ucagcagguccccgcccac

SEQ ID NO: 6770 - RNA, 19 nt, Artificial Sequence
  Description of Artificial Sequence: Synthetic oligonucleotide
gucagcagguccccgccca

SEQ ID NO: 6771 - RNA, 19 nt, Artificial Sequence
  Description of Artificial Sequence: Synthetic oligonucleotide
ugucagcagguccccgccc

SEQ ID NO: 6772 - RNA, 19 nt, Artificial Sequence
  Description of Artificial Sequence: Synthetic oligonucleotide
gugucagcagguccccgcc

SEQ ID NO: 6773 - RNA, 19 nt, Artificial Sequence
  Description of Artificial Sequence: Synthetic oligonucleotide
agugucagcagguccccgc

SEQ ID NO: 6774 - RNA, 19 nt, Artificial Sequence
  Description of Artificial Sequence: Synthetic oligonucleotide
cagugucagcagguccccg

SEQ ID NO: 6775 - RNA, 19 nt, Artificial Sequence
  Description of Artificial Sequence: Synthetic oligonucleotide
gcagugucagcaggucccc

SEQ ID NO: 6776 - RNA, 19 nt, Artificial Sequence
  Description of Artificial Sequence: Synthetic oligonucleotide
agcagugucagcagguccc

SEQ ID NO: 6777 - RNA, 19 nt, Artificial Sequence
  Description of Artificial Sequence: Synthetic oligonucleotide
cagcagugucagcaggucc

SEQ ID NO: 6778 - RNA, 19 nt, Artificial Sequence
  Description of Artificial Sequence: Synthetic oligonucleotide
ucagcagugucagcagguc

SEQ ID NO: 6779 - RNA, 19 nt, Artificial Sequence
  Description of Artificial Sequence: Synthetic oligonucleotide
cucagcagugucagcaggu

SEQ ID NO: 6780 - RNA, 19 nt, Artificial Sequence
  Description of Artificial Sequence: Synthetic oligonucleotide
gcucagcagugucagcagg

SEQ ID NO: 6781 - RNA, 19 nt, Artificial Sequence
  Description of Artificial Sequence: Synthetic oligonucleotide
ugcucagcagugucagcag

SEQ ID NO: 6782 - RNA, 19 nt, Artificial Sequence
  Description of Artificial Sequence: Synthetic oligonucleotide
uugcucagcagugucagca

SEQ ID NO: 6783 - RNA, 19 nt, Artificial Sequence
  Description of Artificial Sequence: Synthetic oligonucleotide
cuugcucagcagugucagc

SEQ ID NO: 6784 - RNA, 19 nt, Artificial Sequence
  Description of Artificial Sequence: Synthetic oligonucleotide
acuugcucagcagugucag

SEQ ID NO: 6785 - RNA, 19 nt, Artificial Sequence
  Description of Artificial Sequence: Synthetic oligonucleotide
aacuugcucagcaguguca

SEQ ID NO: 6786 - RNA, 19 nt, Artificial Sequence
  Description of Artificial Sequence: Synthetic oligonucleotide
aaacuugcucagcaguguc

SEQ ID NO: 6787 - RNA, 19 nt, Artificial Sequence
  Description of Artificial Sequence: Synthetic oligonucleotide
caaacuugcucagcagugu

SEQ ID NO: 6788 - RNA, 19 nt, Artificial Sequence
  Description of Artificial Sequence: Synthetic oligonucleotide
ccaaacuugcucagcagug

SEQ ID NO: 6789 - RNA, 19 nt, Artificial Sequence
  Description of Artificial Sequence: Synthetic oligonucleotide
cccaaacuugcucagcagu

SEQ ID NO: 6790 - RNA, 19 nt, Artificial Sequence
  Description of Artificial Sequence: Synthetic oligonucleotide
ccccaaacuugcucagcag

SEQ ID NO: 6791 - RNA, 19 nt, Artificial Sequence
  Description of Artificial Sequence: Synthetic oligonucleotide
uccccaaacuugcucagca

SEQ ID NO: 6792 - RNA, 19 nt, Artificial Sequence
  Description of Artificial Sequence: Synthetic oligonucleotide
cuccccaaacuugcucagc

SEQ ID NO: 6793 - RNA, 19 nt, Artificial Sequence
  Description of Artificial Sequence: Synthetic oligonucleotide
gcuccccaaacuugcucag

SEQ ID NO: 6794 - RNA, 19 nt, Artificial Sequence
  Description of Artificial Sequence: Synthetic oligonucleotide
cgcuccccaaacuugcuca

SEQ ID NO: 6795 - RNA, 19 nt, Artificial Sequence
  Description of Artificial Sequence: Synthetic oligonucleotide
ccgcuccccaaacuugcuc

SEQ ID NO: 6796 - RNA, 19 nt, Artificial Sequence
  Description of Artificial Sequence: Synthetic oligonucleotide
uccgcuccccaaacuugcu

SEQ ID NO: 6797 - RNA, 19 nt, Artificial Sequence
  Description of Artificial Sequence: Synthetic oligonucleotide
auccgcuccccaaacuugc

SEQ ID NO: 6798 - RNA, 19 nt, Artificial Sequence
  Description of Artificial Sequence: Synthetic oligonucleotide
aauccgcuccccaaacuug

SEQ ID NO: 6799 - RNA, 19 nt, Artificial Sequence
  Description of Artificial Sequence: Synthetic oligonucleotide
gaauccgcuccccaaacuu

SEQ ID NO: 6800 - RNA, 19 nt, Artificial Sequence
  Description of Artificial Sequence: Synthetic oligonucleotide
ggaauccgcuccccaaacu

SEQ ID NO: 6801 - RNA, 19 nt, Artificial Sequence
  Description of Artificial Sequence: Synthetic oligonucleotide
cggaauccgcuccccaaac

SEQ ID NO: 6802 - RNA, 19 nt, Artificial Sequence
  Description of Artificial Sequence: Synthetic oligonucleotide
ccggaauccgcuccccaaa

SEQ ID NO: 6803 - RNA, 19 nt, Artificial Sequence
  Description of Artificial Sequence: Synthetic oligonucleotide
gccggaauccgcuccccaa

SEQ ID NO: 6804 - RNA, 19 nt, Artificial Sequence
  Description of Artificial Sequence: Synthetic oligonucleotide
ggccggaauccgcucccca

SEQ ID NO: 6805 - RNA, 19 nt, Artificial Sequence
  Description of Artificial Sequence: Synthetic oligonucleotide
cggccggaauccgcucccc

SEQ ID NO: 6806 - RNA, 19 nt, Artificial Sequence
  Description of Artificial Sequence: Synthetic oligonucleotide
ucggccggaauccgcuccc

SEQ ID NO: 6807 - RNA, 19 nt, Artificial Sequence
  Description of Artificial Sequence: Synthetic oligonucleotide
cucggccggaauccgcucc

SEQ ID NO: 6808 - RNA, 19 nt, Artificial Sequence
  Description of Artificial Sequence: Synthetic oligonucleotide
ucucggccggaauccgcuc

SEQ ID NO: 6809 - RNA, 19 nt, Artificial Sequence
  Description of Artificial Sequence: Synthetic oligonucleotide
aucucggccggaauccgcu

SEQ ID NO: 6810 - RNA, 19 nt, Artificial Sequence
  Description of Artificial Sequence: Synthetic oligonucleotide
caucucggccggaauccgc

SEQ ID NO: 6811 - RNA, 19 nt, Artificial Sequence
  Description of Artificial Sequence: Synthetic oligonucleotide
ccaucucggccggaauccg

SEQ ID NO: 6812 - RNA, 19 nt, Artificial Sequence
  Description of Artificial Sequence: Synthetic oligonucleotide
gccaucucggccggaaucc

SEQ ID NO: 6813 - RNA, 19 nt, Artificial Sequence
  Description of Artificial Sequence: Synthetic oligonucleotide
cgccaucucggccggaauc

SEQ ID NO: 6814 - RNA, 19 nt, Artificial Sequence
  Description of Artificial Sequence: Synthetic oligonucleotide
gcgccaucucggccggaau

SEQ ID NO: 6815 - RNA, 19 nt, Artificial Sequence
  Description of Artificial Sequence: Synthetic oligonucleotide
cgcgccaucucggccggaa

SEQ ID NO: 6816 - RNA, 19 nt, Artificial Sequence
  Description of Artificial Sequence: Synthetic oligonucleotide
gcgcgccaucucggccgga

SEQ ID NO: 6817 - RNA, 19 nt, Artificial Sequence
  Description of Artificial Sequence: Synthetic oligonucleotide
agcgcgccaucucggccgg

SEQ ID NO: 6818 - RNA, 19 nt, Artificial Sequence
  Description of Artificial Sequence: Synthetic oligonucleotide
aagcgcgccaucucggccg

SEQ ID NO: 6819 - RNA, 19 nt, Artificial Sequence
  Description of Artificial Sequence: Synthetic oligonucleotide
gaagcgcgccaucucggcc

SEQ ID NO: 6820 - RNA, 19 nt, Artificial Sequence
  Description of Artificial Sequence: Synthetic oligonucleotide
agaagcgcgccaucucggc

SEQ ID NO: 6821 - RNA, 19 nt, Artificial Sequence
  Description of Artificial Sequence: Synthetic oligonucleotide
uagaagcgcgccaucucgg

SEQ ID NO: 6822 - RNA, 19 nt, Artificial Sequence
  Description of Artificial Sequence: Synthetic oligonucleotide
guagaagcgcgccaucucg

SEQ ID NO: 6823 - RNA, 19 nt, Artificial Sequence
  Description of Artificial Sequence: Synthetic oligonucleotide
gguagaagcgcgccaucuc

SEQ ID NO: 6824 - RNA, 19 nt, Artificial Sequence
  Description of Artificial Sequence: Synthetic oligonucleotide
agguagaagcgcgccaucu

SEQ ID NO: 6825 - RNA, 19 nt, Artificial Sequence
  Description of Artificial Sequence: Synthetic oligonucleotide
cagguagaagcgcgccauc

SEQ ID NO: 6826 - RNA, 19 nt, Artificial Sequence
  Description of Artificial Sequence: Synthetic oligonucleotide
ccagguagaagcgcgccau

SEQ ID NO: 6827 - RNA, 19 nt, Artificial Sequence
  Description of Artificial Sequence: Synthetic oligonucleotide
gccagguagaagcgcgcca

SEQ ID NO: 6828 - RNA, 19 nt, Artificial Sequence
  Description of Artificial Sequence: Synthetic oligonucleotide
cgccagguagaagcgcgcc

SEQ ID NO: 6829 - RNA, 19 nt, Artificial Sequence
  Description of Artificial Sequence: Synthetic oligonucleotide
ccgccagguagaagcgcgc

SEQ ID NO: 6830 - RNA, 19 nt, Artificial Sequence
  Description of Artificial Sequence: Synthetic oligonucleotide
uccgccagguagaagcgcg

SEQ ID NO: 6831 - RNA, 19 nt, Artificial Sequence
  Description of Artificial Sequence: Synthetic oligonucleotide
cuccgccagguagaagcgc

SEQ ID NO: 6832 - RNA, 19 nt, Artificial Sequence
  Description of Artificial Sequence: Synthetic oligonucleotide
ucuccgccagguagaagcg

SEQ ID NO: 6833 - RNA, 19 nt, Artificial Sequence
  Description of Artificial Sequence: Synthetic oligonucleotide
aucuccgccagguagaagc

SEQ ID NO: 6834 - RNA, 19 nt, Artificial Sequence
  Description of Artificial Sequence: Synthetic oligonucleotide
aaucuccgccagguagaag

SEQ ID NO: 6835 - RNA, 19 nt, Artificial Sequence
  Description of Artificial Sequence: Synthetic oligonucleotide
caaucuccgccagguagaa

SEQ ID NO: 6836 - RNA, 19 nt, Artificial Sequence
  Description of Artificial Sequence: Synthetic oligonucleotide
acaaucuccgccagguaga

SEQ ID NO: 6837 - RNA, 19 nt, Artificial Sequence
  Description of Artificial Sequence: Synthetic oligonucleotide
gacaaucuccgccagguag

SEQ ID NO: 6838 - RNA, 19 nt, Artificial Sequence
  Description of Artificial Sequence: Synthetic oligonucleotide
ugacaaucuccgccaggua

SEQ ID NO: 6839 - RNA, 19 nt, Artificial Sequence
  Description of Artificial Sequence: Synthetic oligonucleotide
augacaaucuccgccaggu

SEQ ID NO: 6840 - RNA, 19 nt, Artificial Sequence
  Description of Artificial Sequence: Synthetic oligonucleotide
caugacaaucuccgccagg

SEQ ID NO: 6841 - RNA, 19 nt, Artificial Sequence
  Description of Artificial Sequence: Synthetic oligonucleotide
ccaugacaaucuccgccag

SEQ ID NO: 6842 - RNA, 19 nt, Artificial Sequence
  Description of Artificial Sequence: Synthetic oligonucleotide
gccaugacaaucuccgcca

SEQ ID NO: 6843 - RNA, 19 nt, Artificial Sequence
  Description of Artificial Sequence: Synthetic oligonucleotide
ggccaugacaaucuccgcc

SEQ ID NO: 6844 - RNA, 19 nt, Artificial Sequence
  Description of Artificial Sequence: Synthetic oligonucleotide
uggccaugacaaucuccgc

SEQ ID NO: 6845 - RNA, 19 nt, Artificial Sequence
  Description of Artificial Sequence: Synthetic oligonucleotide
auggccaugacaaucuccg

SEQ ID NO: 6846 - RNA, 19 nt, Artificial Sequence
  Description of Artificial Sequence: Synthetic oligonucleotide
uauggccaugacaaucucc

SEQ ID NO: 6847 - RNA, 19 nt, Artificial Sequence
  Description of Artificial Sequence: Synthetic oligonucleotide
cuauggccaugacaaucuc

SEQ ID NO: 6848 - RNA, 19 nt, Artificial Sequence
  Description of Artificial Sequence: Synthetic oligonucleotide
ucuauggccaugacaaucu

SEQ ID NO: 6849 - RNA, 19 nt, Artificial Sequence
  Description of Artificial Sequence: Synthetic oligonucleotide
gucuauggccaugacaauc

SEQ ID NO: 6850 - RNA, 19 nt, Artificial Sequence
  Description of Artificial Sequence: Synthetic oligonucleotide
agucuauggccaugacaau

SEQ ID NO: 6851 - RNA, 19 nt, Artificial Sequence
  Description of Artificial Sequence: Synthetic oligonucleotide
gagucuauggccaugacaa

SEQ ID NO: 6852 - RNA, 19 nt, Artificial Sequence
  Description of Artificial Sequence: Synthetic oligonucleotide
cgagucuauggccaugaca

SEQ ID NO: 6853 - RNA, 19 nt, Artificial Sequence
  Description of Artificial Sequence: Synthetic oligonucleotide
ccgagucuauggccaugac

SEQ ID NO: 6854 - RNA, 19 nt, Artificial Sequence
  Description of Artificial Sequence: Synthetic oligonucleotide
accgagucuauggccauga

SEQ ID NO: 6855 - RNA, 19 nt, Artificial Sequence
  Description of Artificial Sequence: Synthetic oligonucleotide
caccgagucuauggccaug

SEQ ID NO: 6856 - RNA, 19 nt, Artificial Sequence
  Description of Artificial Sequence: Synthetic oligonucleotide
gcaccgagucuauggccau

SEQ ID NO: 6857 - RNA, 19 nt, Artificial Sequence
  Description of Artificial Sequence: Synthetic oligonucleotide
ugcaccgagucuauggcca

SEQ ID NO: 6858 - RNA, 19 nt, Artificial Sequence
  Description of Artificial Sequence: Synthetic oligonucleotide
gugcaccgagucuauggcc

SEQ ID NO: 6859 - RNA, 19 nt, Artificial Sequence
  Description of Artificial Sequence: Synthetic oligonucleotide
ggugcaccgagucuauggc

SEQ ID NO: 6860 - RNA, 19 nt, Artificial Sequence
  Description of Artificial Sequence: Synthetic oligonucleotide
cggugcaccgagucuaugg

SEQ ID NO: 6861 - RNA, 19 nt, Artificial Sequence
  Description of Artificial Sequence: Synthetic oligonucleotide
ccggugcaccgagucuaug

SEQ ID NO: 6862 - RNA, 19 nt, Artificial Sequence
  Description of Artificial Sequence: Synthetic oligonucleotide
gccggugcaccgagucuau

SEQ ID NO: 6863 - RNA, 19 nt, Artificial Sequence
  Description of Artificial Sequence: Synthetic oligonucleotide
agccggugcaccgagucua

SEQ ID NO: 6864 - RNA, 19 nt, Artificial Sequence
  Description of Artificial Sequence: Synthetic oligonucleotide
aagccggugcaccgagucu

SEQ ID NO: 6865 - RNA, 19 nt, Artificial Sequence
  Description of Artificial Sequence: Synthetic oligonucleotide
caagccggugcaccgaguc

SEQ ID NO: 6866 - RNA, 19 nt, Artificial Sequence
  Description of Artificial Sequence: Synthetic oligonucleotide
ccaagccggugcaccgagu

SEQ ID NO: 6867 - RNA, 19 nt, Artificial Sequence
  Description of Artificial Sequence: Synthetic oligonucleotide
gccaagccggugcaccgag

SEQ ID NO: 6868 - RNA, 19 nt, Artificial Sequence
  Description of Artificial Sequence: Synthetic oligonucleotide
agccaagccggugcaccga

SEQ ID NO: 6869 - RNA, 19 nt, Artificial Sequence
  Description of Artificial Sequence: Synthetic oligonucleotide
uagccaagccggugcaccg

SEQ ID NO: 6870 - RNA, 19 nt, Artificial Sequence
  Description of Artificial Sequence: Synthetic oligonucleotide
guagccaagccggugcacc

SEQ ID NO: 6871 - RNA, 19 nt, Artificial Sequence
  Description of Artificial Sequence: Synthetic oligonucleotide
cguagccaagccggugcac

SEQ ID NO: 6872 - RNA, 19 nt, Artificial Sequence
  Description of Artificial Sequence: Synthetic oligonucleotide
acguagccaagccggugca

SEQ ID NO: 6873 - RNA, 19 nt, Artificial Sequence
  Description of Artificial Sequence: Synthetic oligonucleotide
cacguagccaagccggugc

SEQ ID NO: 6874 - RNA, 19 nt, Artificial Sequence
  Description of Artificial Sequence: Synthetic oligonucleotide
gcacguagccaagccggug

SEQ ID NO: 6875 - RNA, 19 nt, Artificial Sequence
  Description of Artificial Sequence: Synthetic oligonucleotide
ugcacguagccaagccggu

SEQ ID NO: 6876 - RNA, 19 nt, Artificial Sequence
  Description of Artificial Sequence: Synthetic oligonucleotide
gugcacguagccaagccgg

SEQ ID NO: 6877 - RNA, 19 nt, Artificial Sequence
  Description of Artificial Sequence: Synthetic oligonucleotide
ugugcacguagccaagccg

SEQ ID NO: 6878 - RNA, 19 nt, Artificial Sequence
  Description of Artificial Sequence: Synthetic oligonucleotide
cugugcacguagccaagcc

SEQ ID NO: 6879 - RNA, 19 nt, Artificial Sequence
  Description of Artificial Sequence: Synthetic oligonucleotide
ccugugcacguagccaagc

SEQ ID NO: 6880 - RNA, 19 nt, Artificial Sequence
  Description of Artificial Sequence: Synthetic oligonucleotide
cccugugcacguagccaag

SEQ ID NO: 6881 - RNA, 19 nt, Artificial Sequence
  Description of Artificial Sequence: Synthetic oligonucleotide
ucccugugcacguagccaa

SEQ ID NO: 6882 - RNA, 19 nt, Artificial Sequence
  Description of Artificial Sequence: Synthetic oligonucleotide
gucccugugcacguagcca

SEQ ID NO: 6883 - RNA, 19 nt, Artificial Sequence
  Description of Artificial Sequence: Synthetic oligonucleotide
ugucccugugcacguagcc

SEQ ID NO: 6884 - RNA, 19 nt, Artificial Sequence
  Description of Artificial Sequence: Synthetic oligonucleotide
augucccugugcacguagc

SEQ ID NO: 6885 - RNA, 19 nt, Artificial Sequence
  Description of Artificial Sequence: Synthetic oligonucleotide
gaugucccugugcacguag

SEQ ID NO: 6886 - RNA, 19 nt, Artificial Sequence
  Description of Artificial Sequence: Synthetic oligonucleotide
ugaugucccugugcacgua

SEQ ID NO: 6887 - RNA, 19 nt, Artificial Sequence
  Description of Artificial Sequence: Synthetic oligonucleotide
uugaugucccugugcacgu

SEQ ID NO: 6888 - RNA, 19 nt, Artificial Sequence
  Description of Artificial Sequence: Synthetic oligonucleotide
uuugaugucccugugcacg

SEQ ID NO: 6889 - RNA, 19 nt, Artificial Sequence
  Description of Artificial Sequence: Synthetic oligonucleotide
guuugaugucccugugcac

SEQ ID NO: 6890 - RNA, 19 nt, Artificial Sequence
  Description of Artificial Sequence: Synthetic oligonucleotide
gguuugaugucccugugca

SEQ ID NO: 6891 - RNA, 19 nt, Artificial Sequence
  Description of Artificial Sequence: Synthetic oligonucleotide
ggguuugaugucccugugc

SEQ ID NO: 6892 - RNA, 19 nt, Artificial Sequence
  Description of Artificial Sequence: Synthetic oligonucleotide
cggguuugaugucccugug

SEQ ID NO: 6893 - RNA, 19 nt, Artificial Sequence
  Description of Artificial Sequence: Synthetic oligonucleotide
ucggguuugaugucccugu

SEQ ID NO: 6894 - RNA, 19 nt, Artificial Sequence
  Description of Artificial Sequence: Synthetic oligonucleotide
gucggguuugaugucccug

SEQ ID NO: 6895 - RNA, 19 nt, Artificial Sequence
  Description of Artificial Sequence: Synthetic oligonucleotide
ugucggguuugaugucccu

SEQ ID NO: 6896 - RNA, 19 nt, Artificial Sequence
  Description of Artificial Sequence: Synthetic oligonucleotide
uugucggguuugauguccc

SEQ ID NO: 6897 - RNA, 19 nt, Artificial Sequence
  Description of Artificial Sequence: Synthetic oligonucleotide
guugucggguuugaugucc

SEQ ID NO: 6898 - RNA, 19 nt, Artificial Sequence
  Description of Artificial Sequence: Synthetic oligonucleotide
uguugucggguuugauguc

SEQ ID NO: 6899 - RNA, 19 nt, Artificial Sequence
  Description of Artificial Sequence: Synthetic oligonucleotide
auguugucggguuugaugu

SEQ ID NO: 6900 - RNA, 19 nt, Artificial Sequence
  Description of Artificial Sequence: Synthetic oligonucleotide
gauguugucggguuugaug

SEQ ID NO: 6901 - RNA, 19 nt, Artificial Sequence
  Description of Artificial Sequence: Synthetic oligonucleotide
ggauguugucggguuugau

SEQ ID NO: 6902 - RNA, 19 nt, Artificial Sequence
  Description of Artificial Sequence: Synthetic oligonucleotide
aggauguugucggguuuga

SEQ ID NO: 6903 - RNA, 19 nt, Artificial Sequence
  Description of Artificial Sequence: Synthetic oligonucleotide
caggauguugucggguuug

SEQ ID NO: 6904 - RNA, 19 nt, Artificial Sequence
  Description of Artificial Sequence: Synthetic oligonucleotide
gcaggauguugucggguuu

SEQ ID NO: 6905 - RNA, 19 nt, Artificial Sequence
  Description of Artificial Sequence: Synthetic oligonucleotide
agcaggauguugucggguu

SEQ ID NO: 6906 - RNA, 19 nt, Artificial Sequence
  Description of Artificial Sequence: Synthetic oligonucleotide
cagcaggauguugucgggu

SEQ ID NO: 6907 - RNA, 19 nt, Artificial Sequence
  Description of Artificial Sequence: Synthetic oligonucleotide
ccagcaggauguugucggg

SEQ ID NO: 6908 - RNA, 19 nt, Artificial Sequence
  Description of Artificial Sequence: Synthetic oligonucleotide
uccagcaggauguugucgg

SEQ ID NO: 6909 - RNA, 19 nt, Artificial Sequence
  Description of Artificial Sequence: Synthetic oligonucleotide
guccagcaggauguugucg

SEQ ID NO: 6910 - RNA, 19 nt, Artificial Sequence
  Description of Artificial Sequence: Synthetic oligonucleotide
gguccagcaggauguuguc

SEQ ID NO: 6911 - RNA, 19 nt, Artificial Sequence
  Description of Artificial Sequence: Synthetic oligonucleotide
cgguccagcaggauguugu

SEQ ID NO: 6912 - RNA, 19 nt, Artificial Sequence
  Description of Artificial Sequence: Synthetic oligonucleotide
gcgguccagcaggauguug

SEQ ID NO: 6913 - RNA, 19 nt, Artificial Sequence
  Description of Artificial Sequence: Synthetic oligonucleotide
agcgguccagcaggauguu

SEQ ID NO: 6914 - RNA, 19 nt, Artificial Sequence
  Description of Artificial Sequence: Synthetic oligonucleotide
cagcgguccagcaggaugu

SEQ ID NO: 6915 - RNA, 19 nt, Artificial Sequence
  Description of Artificial Sequence: Synthetic oligonucleotide
acagcgguccagcaggaug

SEQ ID NO: 6916 - RNA, 19 nt, Artificial Sequence
  Description of Artificial Sequence: Synthetic oligonucleotide
cacagcgguccagcaggau

SEQ ID NO: 6917 - RNA, 19 nt, Artificial Sequence
  Description of Artificial Sequence: Synthetic oligonucleotide
ccacagcgguccagcagga

SEQ ID NO: 6918 - RNA, 19 nt, Artificial Sequence
  Description of Artificial Sequence: Synthetic oligonucleotide
gccacagcgguccagcagg

SEQ ID NO: 6919 - RNA, 19 nt, Artificial Sequence
  Description of Artificial Sequence: Synthetic oligonucleotide
ggccacagcgguccagcag

SEQ ID NO: 6920 - RNA, 19 nt, Artificial Sequence
  Description of Artificial Sequence: Synthetic oligonucleotide
uggccacagcgguccagca

SEQ ID NO: 6921 - RNA, 19 nt, Artificial Sequence
  Description of Artificial Sequence: Synthetic oligonucleotide
guggccacagcgguccagc

SEQ ID NO: 6922 - RNA, 19 nt, Artificial Sequence
  Description of Artificial Sequence: Synthetic oligonucleotide
uguggccacagcgguccag

SEQ ID NO: 6923 - RNA, 19 nt, Artificial Sequence
  Description of Artificial Sequence: Synthetic oligonucleotide
auguggccacagcggucca

SEQ ID NO: 6924 - RNA, 19 nt, Artificial Sequence
  Description of Artificial Sequence: Synthetic oligonucleotide
gauguggccacagcggucc

SEQ ID NO: 6925 - RNA, 19 nt, Artificial Sequence
  Description of Artificial Sequence: Synthetic oligonucleotide
ggauguggccacagcgguc

SEQ ID NO: 6926 - RNA, 19 nt, Artificial Sequence
  Description of Artificial Sequence: Synthetic oligonucleotide
cggauguggccacagcggu

SEQ ID NO: 6927 - RNA, 19 nt, Artificial Sequence
  Description of Artificial Sequence: Synthetic oligonucleotide
gcggauguggccacagcgg

SEQ ID NO: 6928 - RNA, 19 nt, Artificial Sequence
  Description of Artificial Sequence: Synthetic oligonucleotide
ggcggauguggccacagcg

SEQ ID NO: 6929 - RNA, 19 nt, Artificial Sequence
  Description of Artificial Sequence: Synthetic oligonucleotide
aggcggauguggccacagc

SEQ ID NO: 6930 - RNA, 19 nt, Artificial Sequence
  Description of Artificial Sequence: Synthetic oligonucleotide
caggcggauguggccacag

SEQ ID NO: 6931 - RNA, 19 nt, Artificial Sequence
  Description of Artificial Sequence: Synthetic oligonucleotide
ccaggcggauguggccaca

SEQ ID NO: 6932 - RNA, 19 nt, Artificial Sequence
  Description of Artificial Sequence: Synthetic oligonucleotide
gccaggcggauguggccac

SEQ ID NO: 6933 - RNA, 19 nt, Artificial Sequence
  Description of Artificial Sequence: Synthetic oligonucleotide
ggccaggcggauguggcca

SEQ ID NO: 6934 - RNA, 19 nt, Artificial Sequence
  Description of Artificial Sequence: Synthetic oligonucleotide
cggccaggcggauguggcc

SEQ ID NO: 6935 - RNA, 19 nt, Artificial Sequence
  Description of Artificial Sequence: Synthetic oligonucleotide
ucggccaggcggauguggc

SEQ ID NO: 6936 - RNA, 19 nt, Artificial Sequence
  Description of Artificial Sequence: Synthetic oligonucleotide
gucggccaggcggaugugg

SEQ ID NO: 6937 - RNA, 19 nt, Artificial Sequence
  Description of Artificial Sequence: Synthetic oligonucleotide
agucggccaggcggaugug

SEQ ID NO: 6938 - RNA, 19 nt, Artificial Sequence
  Description of Artificial Sequence: Synthetic oligonucleotide
aagucggccaggcggaugu

SEQ ID NO: 6939 - RNA, 19 nt, Artificial Sequence
  Description of Artificial Sequence: Synthetic oligonucleotide
gaagucggccaggcggaug

SEQ ID NO: 6940 - RNA, 19 nt, Artificial Sequence
  Description of Artificial Sequence: Synthetic oligonucleotide
cgaagucggccaggcggau

SEQ ID NO: 6941 - RNA, 19 nt, Artificial Sequence
  Description of Artificial Sequence: Synthetic oligonucleotide
ccgaagucggccaggcgga

SEQ ID NO: 6942 - RNA, 19 nt, Artificial Sequence
  Description of Artificial Sequence: Synthetic oligonucleotide
gccgaagucggccaggcgg

SEQ ID NO: 6943 - RNA, 19 nt, Artificial Sequence
  Description of Artificial Sequence: Synthetic oligonucleotide
agccgaagucggccaggcg

SEQ ID NO: 6944 - RNA, 19 nt, Artificial Sequence
  Description of Artificial Sequence: Synthetic oligonucleotide
gagccgaagucggccaggc

SEQ ID NO: 6945 - RNA, 19 nt, Artificial Sequence
  Description of Artificial Sequence: Synthetic oligonucleotide
agagccgaagucggccagg

SEQ ID NO: 6946 - RNA, 19 nt, Artificial Sequence
  Description of Artificial Sequence: Synthetic oligonucleotide
aagagccgaagucggccag

SEQ ID NO: 6947 - RNA, 19 nt, Artificial Sequence
  Description of Artificial Sequence: Synthetic oligonucleotide
caagagccgaagucggcca

SEQ ID NO: 6948 - RNA, 19 nt, Artificial Sequence
  Description of Artificial Sequence: Synthetic oligonucleotide
gcaagagccgaagucggcc

SEQ ID NO: 6949 - RNA, 19 nt, Artificial Sequence
  Description of Artificial Sequence: Synthetic oligonucleotide
ggcaagagccgaagucggc

SEQ ID NO: 6950 - RNA, 19 nt, Artificial Sequence
  Description of Artificial Sequence: Synthetic oligonucleotide
aggcaagagccgaagucgg

SEQ ID NO: 6951 - RNA, 19 nt, Artificial Sequence
  Description of Artificial Sequence: Synthetic oligonucleotide
gaggcaagagccgaagucg

SEQ ID NO: 6952 - RNA, 19 nt, Artificial Sequence
  Description of Artificial Sequence: Synthetic oligonucleotide
ugaggcaagagccgaaguc

SEQ ID NO: 6953 - RNA, 19 nt, Artificial Sequence
  Description of Artificial Sequence: Synthetic oligonucleotide
uugaggcaagagccgaagu

SEQ ID NO: 6954 - RNA, 19 nt, Artificial Sequence
  Description of Artificial Sequence: Synthetic oligonucleotide
cuugaggcaagagccgaag

SEQ ID NO: 6955 - RNA, 19 nt, Artificial Sequence
  Description of Artificial Sequence: Synthetic oligonucleotide
gcuugaggcaagagccgaa

SEQ ID NO: 6956 - RNA, 19 nt, Artificial Sequence
  Description of Artificial Sequence: Synthetic oligonucleotide
agcuugaggcaagagccga

SEQ ID NO: 6957 - RNA, 19 nt, Artificial Sequence
  Description of Artificial Sequence: Synthetic oligonucleotide
cagcuugaggcaagagccg

SEQ ID NO: 6958 - RNA, 19 nt, Artificial Sequence
  Description of Artificial Sequence: Synthetic oligonucleotide
gcagcuugaggcaagagcc

SEQ ID NO: 6959 - RNA, 19 nt, Artificial Sequence
  Description of Artificial Sequence: Synthetic oligonucleotide
cgcagcuugaggcaagagc

SEQ ID NO: 6960 - RNA, 19 nt, Artificial Sequence
  Description of Artificial Sequence: Synthetic oligonucleotide
ccgcagcuugaggcaagag

SEQ ID NO: 6961 - RNA, 19 nt, Artificial Sequence
  Description of Artificial Sequence: Synthetic oligonucleotide
cccgcagcuugaggcaaga

SEQ ID NO: 6962 - RNA, 19 nt, Artificial Sequence
  Description of Artificial Sequence: Synthetic oligonucleotide
gcccgcagcuugaggcaag

SEQ ID NO: 6963 - RNA, 19 nt, Artificial Sequence
  Description of Artificial Sequence: Synthetic oligonucleotide
ugcccgcagcuugaggcaa

SEQ ID NO: 6964 - RNA, 19 nt, Artificial Sequence
  Description of Artificial Sequence: Synthetic oligonucleotide
cugcccgcagcuugaggca

SEQ ID NO: 6965 - RNA, 19 nt, Artificial Sequence
  Description of Artificial Sequence: Synthetic oligonucleotide
ucugcccgcagcuugaggc

SEQ ID NO: 6966 - RNA, 19 nt, Artificial Sequence
  Description of Artificial Sequence: Synthetic oligonucleotide
aucugcccgcagcuugagg

SEQ ID NO: 6967 - RNA, 19 nt, Artificial Sequence
  Description of Artificial Sequence: Synthetic oligonucleotide
caucugcccgcagcuugag

SEQ ID NO: 6968 - RNA, 19 nt, Artificial Sequence
  Description of Artificial Sequence: Synthetic oligonucleotide
ccaucugcccgcagcuuga

SEQ ID NO: 6969 - RNA, 19 nt, Artificial Sequence
  Description of Artificial Sequence: Synthetic oligonucleotide
uccaucugcccgcagcuug

SEQ ID NO: 6970 - RNA, 19 nt, Artificial Sequence
  Description of Artificial Sequence: Synthetic oligonucleotide
uuccaucugcccgcagcuu

SEQ ID NO: 6971 - RNA, 19 nt, Artificial Sequence
  Description of Artificial Sequence: Synthetic oligonucleotide
guuccaucugcccgcagcu

SEQ ID NO: 6972 - RNA, 19 nt, Artificial Sequence
  Description of Artificial Sequence: Synthetic oligonucleotide
cguuccaucugcccgcagc

SEQ ID NO: 6973 - RNA, 19 nt, Artificial Sequence
  Description of Artificial Sequence: Synthetic oligonucleotide
ccguuccaucugcccgcag

SEQ ID NO: 6974 - RNA, 19 nt, Artificial Sequence
  Description of Artificial Sequence: Synthetic oligonucleotide
accguuccaucugcccgca

SEQ ID NO: 6975 - RNA, 19 nt, Artificial Sequence
  Description of Artificial Sequence: Synthetic oligonucleotide
caccguuccaucugcccgc

SEQ ID NO: 6976 - RNA, 19 nt, Artificial Sequence
  Description of Artificial Sequence: Synthetic oligonucleotide
gcaccguuccaucugcccg

SEQ ID NO: 6977 - RNA, 19 nt, Artificial Sequence
  Description of Artificial Sequence: Synthetic oligonucleotide
cgcaccguuccaucugccc

SEQ ID NO: 6978 - RNA, 19 nt, Artificial Sequence
  Description of Artificial Sequence: Synthetic oligonucleotide
ccgcaccguuccaucugcc

SEQ ID NO: 6979 - RNA, 19 nt, Artificial Sequence
  Description of Artificial Sequence: Synthetic oligonucleotide
accgcaccguuccaucugc

SEQ ID NO: 6980 - RNA, 19 nt, Artificial Sequence
  Description of Artificial Sequence: Synthetic oligonucleotide
gaccgcaccguuccaucug

SEQ ID NO: 6981 - RNA, 19 nt, Artificial Sequence
  Description of Artificial Sequence: Synthetic oligonucleotide
cgaccgcaccguuccaucu

SEQ ID NO: 6982 - RNA, 19 nt, Artificial Sequence
  Description of Artificial Sequence: Synthetic oligonucleotide
gcgaccgcaccguuccauc

SEQ ID NO: 6983 - RNA, 19 nt, Artificial Sequence
  Description of Artificial Sequence: Synthetic oligonucleotide
agcgaccgcaccguuccau

SEQ ID NO: 6984 - RNA, 19 nt, Artificial Sequence
  Description of Artificial Sequence: Synthetic oligonucleotide
cagcgaccgcaccguucca

SEQ ID NO: 6985 - RNA, 19 nt, Artificial Sequence
  Description of Artificial Sequence: Synthetic oligonucleotide
ccagcgaccgcaccguucc

SEQ ID NO: 6986 - RNA, 19 nt, Artificial Sequence
  Description of Artificial Sequence: Synthetic oligonucleotide
accagcgaccgcaccguuc

SEQ ID NO: 6987 - RNA, 19 nt, Artificial Sequence
  Description of Artificial Sequence: Synthetic oligonucleotide
caccagcgaccgcaccguu

SEQ ID NO: 6988 - RNA, 19 nt, Artificial Sequence
  Description of Artificial Sequence: Synthetic oligonucleotide
ccaccagcgaccgcaccgu

SEQ ID NO: 6989 - RNA, 19 nt, Artificial Sequence
  Description of Artificial Sequence: Synthetic oligonucleotide
gccaccagcgaccgcaccg

SEQ ID NO: 6990 - RNA, 19 nt, Artificial Sequence
  Description of Artificial Sequence: Synthetic oligonucleotide
agccaccagcgaccgcacc

SEQ ID NO: 6991 - RNA, 19 nt, Artificial Sequence
  Description of Artificial Sequence: Synthetic oligonucleotide
cagccaccagcgaccgcac

SEQ ID NO: 6992 - RNA, 19 nt, Artificial Sequence
  Description of Artificial Sequence: Synthetic oligonucleotide
acagccaccagcgaccgca

SEQ ID NO: 6993 - RNA, 19 nt, Artificial Sequence
  Description of Artificial Sequence: Synthetic oligonucleotide
cacagccaccagcgaccgc

SEQ ID NO: 6994 - RNA, 19 nt, Artificial Sequence
  Description of Artificial Sequence: Synthetic oligonucleotide
ccacagccaccagcgaccg

SEQ ID NO: 6995 - RNA, 19 nt, Artificial Sequence
  Description of Artificial Sequence: Synthetic oligonucleotide
cccacagccaccagcgacc

SEQ ID NO: 6996 - RNA, 19 nt, Artificial Sequence
  Description of Artificial Sequence: Synthetic oligonucleotide
gcccacagccaccagcgac

SEQ ID NO: 6997 - RNA, 19 nt, Artificial Sequence
  Description of Artificial Sequence: Synthetic oligonucleotide
ugcccacagccaccagcga

SEQ ID NO: 6998 - RNA, 19 nt, Artificial Sequence
  Description of Artificial Sequence: Synthetic oligonucleotide
gugcccacagccaccagcg

SEQ ID NO: 6999 - RNA, 19 nt, Artificial Sequence
  Description of Artificial Sequence: Synthetic oligonucleotide
ggugcccacagccaccagc

SEQ ID NO: 7000 - RNA, 19 nt, Artificial Sequence
  Description of Artificial Sequence: Synthetic oligonucleotide
gggugcccacagccaccag

SEQ ID NO: 7001 - RNA, 19 nt, Artificial Sequence
  Description of Artificial Sequence: Synthetic oligonucleotide
ggggugcccacagccacca

SEQ ID NO: 7002 - RNA, 19 nt, Artificial Sequence
  Description of Artificial Sequence: Synthetic oligonucleotide
uggggugcccacagccacc

SEQ ID NO: 7003 - RNA, 19 nt, Artificial Sequence
  Description of Artificial Sequence: Synthetic oligonucleotide
cuggggugcccacagccac

SEQ ID NO: 7004 - RNA, 19 nt, Artificial Sequence
  Description of Artificial Sequence: Synthetic oligonucleotide
ucuggggugcccacagcca

SEQ ID NO: 7005 - RNA, 19 nt, Artificial Sequence
  Description of Artificial Sequence: Synthetic oligonucleotide
gucuggggugcccacagcc

SEQ ID NO: 7006 - RNA, 19 nt, Artificial Sequence
  Description of Artificial Sequence: Synthetic oligonucleotide
agucuggggugcccacagc

SEQ ID NO: 7007 - RNA, 19 nt, Artificial Sequence
  Description of Artificial Sequence: Synthetic oligonucleotide
uagucuggggugcccacag

SEQ ID NO: 7008 - RNA, 19 nt, Artificial Sequence
  Description of Artificial Sequence: Synthetic oligonucleotide
guagucuggggugcccaca

SEQ ID NO: 7009 - RNA, 19 nt, Artificial Sequence
  Description of Artificial Sequence: Synthetic oligonucleotide
gguagucuggggugcccac

SEQ ID NO: 7010 - RNA, 19 nt, Artificial Sequence
  Description of Artificial Sequence: Synthetic oligonucleotide
agguagucuggggugccca

SEQ ID NO: 7011 - RNA, 19 nt, Artificial Sequence
  Description of Artificial Sequence: Synthetic oligonucleotide
cagguagucuggggugccc

SEQ ID NO: 7012 - RNA, 19 nt, Artificial Sequence
  Description of Artificial Sequence: Synthetic oligonucleotide
acagguagucuggggugcc

SEQ ID NO: 7013 - RNA, 19 nt, Artificial Sequence
  Description of Artificial Sequence: Synthetic oligonucleotide
gacagguagucuggggugc

SEQ ID NO: 7014 - RNA, 19 nt, Artificial Sequence
  Description of Artificial Sequence: Synthetic oligonucleotide
ggacagguagucuggggug

SEQ ID NO: 7015 - RNA, 19 nt, Artificial Sequence
  Description of Artificial Sequence: Synthetic oligonucleotide
gggacagguagucuggggu

SEQ ID NO: 7016 - RNA, 19 nt, Artificial Sequence
  Description of Artificial Sequence: Synthetic oligonucleotide
ggggacagguagucugggg

SEQ ID NO: 7017 - RNA, 19 nt, Artificial Sequence
  Description of Artificial Sequence: Synthetic oligonucleotide
gggggacagguagucuggg

SEQ ID NO: 7018 - RNA, 19 nt, Artificial Sequence
  Description of Artificial Sequence: Synthetic oligonucleotide
cgggggacagguagucugg

SEQ ID NO: 7019 - RNA, 19 nt, Artificial Sequence
  Description of Artificial Sequence: Synthetic oligonucleotide
ucgggggacagguagucug

SEQ ID NO: 7020 - RNA, 19 nt, Artificial Sequence
  Description of Artificial Sequence: Synthetic oligonucleotide
cucgggggacagguagucu

SEQ ID NO: 7021 - RNA, 19 nt, Artificial Sequence
  Description of Artificial Sequence: Synthetic oligonucleotide
ucucgggggacagguaguc

SEQ ID NO: 7022 - RNA, 19 nt, Artificial Sequence
  Description of Artificial Sequence: Synthetic oligonucleotide
aucucgggggacagguagu

SEQ ID NO: 7023 - RNA, 19 nt, Artificial Sequence
  Description of Artificial Sequence: Synthetic oligonucleotide
gaucucgggggacagguag

SEQ ID NO: 7024 - RNA, 19 nt, Artificial Sequence
  Description of Artificial Sequence: Synthetic oligonucleotide
ggaucucgggggacaggua

SEQ ID NO: 7025 - RNA, 19 nt, Artificial Sequence
  Description of Artificial Sequence: Synthetic oligonucleotide
aggaucucgggggacaggu

SEQ ID NO: 7026 - RNA, 19 nt, Artificial Sequence
  Description of Artificial Sequence: Synthetic oligonucleotide
caggaucucgggggacagg

SEQ ID NO: 7027 - RNA, 19 nt, Artificial Sequence
  Description of Artificial Sequence: Synthetic oligonucleotide
gcaggaucucgggggacag

SEQ ID NO: 7028 - RNA, 19 nt, Artificial Sequence
  Description of Artificial Sequence: Synthetic oligonucleotide
ugcaggaucucgggggaca

SEQ ID NO: 7029 - RNA, 19 nt, Artificial Sequence
  Description of Artificial Sequence: Synthetic oligonucleotide
cugcaggaucucgggggac

SEQ ID NO: 7030 - RNA, 19 nt, Artificial Sequence
  Description of Artificial Sequence: Synthetic oligonucleotide
ccugcaggaucucggggga

SEQ ID NO: 7031 - RNA, 19 nt, Artificial Sequence
  Description of Artificial Sequence: Synthetic oligonucleotide
gccugcaggaucucggggg

SEQ ID NO: 7032 - RNA, 19 nt, Artificial Sequence
  Description of Artificial Sequence: Synthetic oligonucleotide
agccugcaggaucucgggg

SEQ ID NO: 7033 - RNA, 19 nt, Artificial Sequence
  Description of Artificial Sequence: Synthetic oligonucleotide
cagccugcaggaucucggg

SEQ ID NO: 7034 - RNA, 19 nt, Artificial Sequence
  Description of Artificial Sequence: Synthetic oligonucleotide
acagccugcaggaucucgg

SEQ ID NO: 7035 - RNA, 19 nt, Artificial Sequence
  Description of Artificial Sequence: Synthetic oligonucleotide
cacagccugcaggaucucg

SEQ ID NO: 7036 - RNA, 19 nt, Artificial Sequence
  Description of Artificial Sequence: Synthetic oligonucleotide
ccacagccugcaggaucuc

SEQ ID NO: 7037 - RNA, 19 nt, Artificial Sequence
  Description of Artificial Sequence: Synthetic oligonucleotide
cccacagccugcaggaucu

SEQ ID NO: 7038 - RNA, 19 nt, Artificial Sequence
  Description of Artificial Sequence: Synthetic oligonucleotide
gcccacagccugcaggauc

SEQ ID NO: 7039 - RNA, 19 nt, Artificial Sequence
  Description of Artificial Sequence: Synthetic oligonucleotide
cgcccacagccugcaggau

SEQ ID NO: 7040 - RNA, 19 nt, Artificial Sequence
  Description of Artificial Sequence: Synthetic oligonucleotide
ccgcccacagccugcagga

SEQ ID NO: 7041 - RNA, 19 nt, Artificial Sequence
  Description of Artificial Sequence: Synthetic oligonucleotide
accgcccacagccugcagg

SEQ ID NO: 7042 - RNA, 19 nt, Artificial Sequence
  Description of Artificial Sequence: Synthetic oligonucleotide
caccgcccacagccugcag

SEQ ID NO: 7043 - RNA, 19 nt, Artificial Sequence
  Description of Artificial Sequence: Synthetic oligonucleotide
ccaccgcccacagccugca

SEQ ID NO: 7044 - RNA, 19 nt, Artificial Sequence
  Description of Artificial Sequence: Synthetic oligonucleotide
cccaccgcccacagccugc

SEQ ID NO: 7045 - RNA, 19 nt, Artificial Sequence
  Description of Artificial Sequence: Synthetic oligonucleotide
gcccaccgcccacagccug

SEQ ID NO: 7046 - RNA, 19 nt, Artificial Sequence
  Description of Artificial Sequence: Synthetic oligonucleotide
ggcccaccgcccacagccu

SEQ ID NO: 7047 - RNA, 19 nt, Artificial Sequence
  Description of Artificial Sequence: Synthetic oligonucleotide
aggcccaccgcccacagcc

SEQ ID NO: 7048 - RNA, 19 nt, Artificial Sequence
  Description of Artificial Sequence: Synthetic oligonucleotide
caggcccaccgcccacagc

SEQ ID NO: 7049 - RNA, 19 nt, Artificial Sequence
  Description of Artificial Sequence: Synthetic oligonucleotide
ccaggcccaccgcccacag

SEQ ID NO: 7050 - RNA, 19 nt, Artificial Sequence
  Description of Artificial Sequence: Synthetic oligonucleotide
cccaggcccaccgcccaca

SEQ ID NO: 7051 - RNA, 19 nt, Artificial Sequence
  Description of Artificial Sequence: Synthetic oligonucleotide
ucccaggcccaccgcccac

SEQ ID NO: 7052 - RNA, 19 nt, Artificial Sequence
  Description of Artificial Sequence: Synthetic oligonucleotide
gucccaggcccaccgccca

SEQ ID NO: 7053 - RNA, 19 nt, Artificial Sequence
  Description of Artificial Sequence: Synthetic oligonucleotide
ugucccaggcccaccgccc

SEQ ID NO: 7054 - RNA, 19 nt, Artificial Sequence
  Description of Artificial Sequence: Synthetic oligonucleotide
cugucccaggcccaccgcc

SEQ ID NO: 7055 - RNA, 19 nt, Artificial Sequence
  Description of Artificial Sequence: Synthetic oligonucleotide
ccugucccaggcccaccgc

SEQ ID NO: 7056 - RNA, 19 nt, Artificial Sequence
  Description of Artificial Sequence: Synthetic oligonucleotide
gccugucccaggcccaccg

SEQ ID NO: 7057 - RNA, 19 nt, Artificial Sequence
  Description of Artificial Sequence: Synthetic oligonucleotide
ugccugucccaggcccacc

SEQ ID NO: 7058 - RNA, 19 nt, Artificial Sequence
  Description of Artificial Sequence: Synthetic oligonucleotide
cugccugucccaggcccac

SEQ ID NO: 7059 - RNA, 19 nt, Artificial Sequence
  Description of Artificial Sequence: Synthetic oligonucleotide
gcugccugucccaggccca

SEQ ID NO: 7060 - RNA, 19 nt, Artificial Sequence
  Description of Artificial Sequence: Synthetic oligonucleotide
agcugccugucccaggccc

SEQ ID NO: 7061 - RNA, 19 nt, Artificial Sequence
  Description of Artificial Sequence: Synthetic oligonucleotide
uagcugccugucccaggcc

SEQ ID NO: 7062 - RNA, 19 nt, Artificial Sequence
  Description of Artificial Sequence: Synthetic oligonucleotide
guagcugccugucccaggc

SEQ ID NO: 7063 - RNA, 19 nt, Artificial Sequence
  Description of Artificial Sequence: Synthetic oligonucleotide
cguagcugccugucccagg

SEQ ID NO: 7064 - RNA, 19 nt, Artificial Sequence
  Description of Artificial Sequence: Synthetic oligonucleotide
ccguagcugccugucccag

SEQ ID NO: 7065 - RNA, 19 nt, Artificial Sequence
  Description of Artificial Sequence: Synthetic oligonucleotide
cccguagcugccuguccca

SEQ ID NO: 7066 - RNA, 19 nt, Artificial Sequence
  Description of Artificial Sequence: Synthetic oligonucleotide
gcccguagcugccuguccc

SEQ ID NO: 7067 - RNA, 19 nt, Artificial Sequence
  Description of Artificial Sequence: Synthetic oligonucleotide
ggcccguagcugccugucc

SEQ ID NO: 7068 - RNA, 19 nt, Artificial Sequence
  Description of Artificial Sequence: Synthetic oligonucleotide
gggcccguagcugccuguc

SEQ ID NO: 7069 - RNA, 19 nt, Artificial Sequence
  Description of Artificial Sequence: Synthetic oligonucleotide
cgggcccguagcugccugu

SEQ ID NO: 7070 - RNA, 19 nt, Artificial Sequence
  Description of Artificial Sequence: Synthetic oligonucleotide
ucgggcccguagcugccug

SEQ ID NO: 7071 - RNA, 19 nt, Artificial Sequence
  Description of Artificial Sequence: Synthetic oligonucleotide
cucgggcccguagcugccu

SEQ ID NO: 7072 - RNA, 19 nt, Artificial Sequence
  Description of Artificial Sequence: Synthetic oligonucleotide
acucgggcccguagcugcc

SEQ ID NO: 7073 - RNA, 19 nt, Artificial Sequence
  Description of Artificial Sequence: Synthetic oligonucleotide
cacucgggcccguagcugc

SEQ ID NO: 7074 - RNA, 19 nt, Artificial Sequence
  Description of Artificial Sequence: Synthetic oligonucleotide
acacucgggcccguagcug

SEQ ID NO: 7075 - RNA, 19 nt, Artificial Sequence
  Description of Artificial Sequence: Synthetic oligonucleotide
cacacucgggcccguagcu

SEQ ID NO: 7076 - RNA, 19 nt, Artificial Sequence
  Description of Artificial Sequence: Synthetic oligonucleotide
ucacacucgggcccguagc

SEQ ID NO: 7077 - RNA, 19 nt, Artificial Sequence
  Description of Artificial Sequence: Synthetic oligonucleotide
gucacacucgggcccguag

SEQ ID NO: 7078 - RNA, 19 nt, Artificial Sequence
  Description of Artificial Sequence: Synthetic oligonucleotide
agucacacucgggcccgua

SEQ ID NO: 7079 - RNA, 19 nt, Artificial Sequence
  Description of Artificial Sequence: Synthetic oligonucleotide
cagucacacucgggcccgu

SEQ ID NO: 7080 - RNA, 19 nt, Artificial Sequence
  Description of Artificial Sequence: Synthetic oligonucleotide
ccagucacacucgggcccg

SEQ ID NO: 7081 - RNA, 19 nt, Artificial Sequence
  Description of Artificial Sequence: Synthetic oligonucleotide
accagucacacucgggccc

SEQ ID NO: 7082 - RNA, 19 nt, Artificial Sequence
  Description of Artificial Sequence: Synthetic oligonucleotide
caccagucacacucgggcc

SEQ ID NO: 7083 - RNA, 19 nt, Artificial Sequence
  Description of Artificial Sequence: Synthetic oligonucleotide
ccaccagucacacucgggc

SEQ ID NO: 7084 - RNA, 19 nt, Artificial Sequence
  Description of Artificial Sequence: Synthetic oligonucleotide
cccaccagucacacucggg

SEQ ID NO: 7085 - RNA, 19 nt, Artificial Sequence
  Description of Artificial Sequence: Synthetic oligonucleotide
gcccaccagucacacucgg

SEQ ID NO: 7086 - RNA, 19 nt, Artificial Sequence
  Description of Artificial Sequence: Synthetic oligonucleotide
cgcccaccagucacacucg

SEQ ID NO: 7087 - RNA, 19 nt, Artificial Sequence
  Description of Artificial Sequence: Synthetic oligonucleotide
gcgcccaccagucacacuc

SEQ ID NO: 7088 - RNA, 19 nt, Artificial Sequence
  Description of Artificial Sequence: Synthetic oligonucleotide
agcgcccaccagucacacu

SEQ ID NO: 7089 - RNA, 19 nt, Artificial Sequence
  Description of Artificial Sequence: Synthetic oligonucleotide
cagcgcccaccagucacac

SEQ ID NO: 7090 - RNA, 19 nt, Artificial Sequence
  Description of Artificial Sequence: Synthetic oligonucleotide
ccagcgcccaccagucaca

SEQ ID NO: 7091 - RNA, 19 nt, Artificial Sequence
  Description of Artificial Sequence: Synthetic oligonucleotide
cccagcgcccaccagucac

SEQ ID NO: 7092 - RNA, 19 nt, Artificial Sequence
  Description of Artificial Sequence: Synthetic oligonucleotide
acccagcgcccaccaguca

SEQ ID NO: 7093 - RNA, 19 nt, Artificial Sequence
  Description of Artificial Sequence: Synthetic oligonucleotide
cacccagcgcccaccaguc

SEQ ID NO: 7094 - RNA, 19 nt, Artificial Sequence
  Description of Artificial Sequence: Synthetic oligonucleotide
acacccagcgcccaccagu

SEQ ID NO: 7095 - RNA, 19 nt, Artificial Sequence
  Description of Artificial Sequence: Synthetic oligonucleotide
uacacccagcgcccaccag

SEQ ID NO: 7096 - RNA, 19 nt, Artificial Sequence
  Description of Artificial Sequence: Synthetic oligonucleotide
auacacccagcgcccacca

SEQ ID NO: 7097 - RNA, 19 nt, Artificial Sequence
  Description of Artificial Sequence: Synthetic oligonucleotide
aauacacccagcgcccacc

SEQ ID NO: 7098 - RNA, 19 nt, Artificial Sequence
  Description of Artificial Sequence: Synthetic oligonucleotide
gaauacacccagcgcccac

SEQ ID NO: 7099 - RNA, 19 nt, Artificial Sequence
  Description of Artificial Sequence: Synthetic oligonucleotide
cgaauacacccagcgccca

SEQ ID NO: 7100 - RNA, 19 nt, Artificial Sequence
  Description of Artificial Sequence: Synthetic oligonucleotide
gcgaauacacccagcgccc

SEQ ID NO: 7101 - RNA, 19 nt, Artificial Sequence
  Description of Artificial Sequence: Synthetic oligonucleotide
ggcgaauacacccagcgcc

SEQ ID NO: 7102 - RNA, 19 nt, Artificial Sequence
  Description of Artificial Sequence: Synthetic oligonucleotide
aggcgaauacacccagcgc

SEQ ID NO: 7103 - RNA, 19 nt, Artificial Sequence
  Description of Artificial Sequence: Synthetic oligonucleotide
uaggcgaauacacccagcg

SEQ ID NO: 7104 - RNA, 19 nt, Artificial Sequence
  Description of Artificial Sequence: Synthetic oligonucleotide
auaggcgaauacacccagc

SEQ ID NO: 7105 - RNA, 19 nt, Artificial Sequence
  Description of Artificial Sequence: Synthetic oligonucleotide
cauaggcgaauacacccag

SEQ ID NO: 7106 - RNA, 19 nt, Artificial Sequence
  Description of Artificial Sequence: Synthetic oligonucleotide
ucauaggcgaauacaccca

SEQ ID NO: 7107 - RNA, 19 nt, Artificial Sequence
  Description of Artificial Sequence: Synthetic oligonucleotide
uucauaggcgaauacaccc

SEQ ID NO: 7108 - RNA, 19 nt, Artificial Sequence
  Description of Artificial Sequence: Synthetic oligonucleotide
uuucauaggcgaauacacc

SEQ ID NO: 7109 - RNA, 19 nt, Artificial Sequence
  Description of Artificial Sequence: Synthetic oligonucleotide
auuucauaggcgaauacac

SEQ ID NO: 7110 - RNA, 19 nt, Artificial Sequence
  Description of Artificial Sequence: Synthetic oligonucleotide
cauuucauaggcgaauaca

SEQ ID NO: 7111 - RNA, 19 nt, Artificial Sequence
  Description of Artificial Sequence: Synthetic oligonucleotide
acauuucauaggcgaauac

SEQ ID NO: 7112 - RNA, 19 nt, Artificial Sequence
  Description of Artificial Sequence: Synthetic oligonucleotide
aacauuucauaggcgaaua

SEQ ID NO: 7113 - RNA, 19 nt, Artificial Sequence
  Description of Artificial Sequence: Synthetic oligonucleotide
gaacauuucauaggcgaau

SEQ ID NO: 7114 - RNA, 19 nt, Artificial Sequence
  Description of Artificial Sequence: Synthetic oligonucleotide
agaacauuucauaggcgaa

SEQ ID NO: 7115 - RNA, 19 nt, Artificial Sequence
  Description of Artificial Sequence: Synthetic oligonucleotide
uagaacauuucauaggcga

SEQ ID NO: 7116 - RNA, 19 nt, Artificial Sequence
  Description of Artificial Sequence: Synthetic oligonucleotide
auagaacauuucauaggcg

SEQ ID NO: 7117 - RNA, 19 nt, Artificial Sequence
  Description of Artificial Sequence: Synthetic oligonucleotide
cauagaacauuucauaggc

SEQ ID NO: 7118 - RNA, 19 nt, Artificial Sequence
  Description of Artificial Sequence: Synthetic oligonucleotide
ccauagaacauuucauagg

SEQ ID NO: 7119 - RNA, 19 nt, Artificial Sequence
  Description of Artificial Sequence: Synthetic oligonucleotide
cccauagaacauuucauag

SEQ ID NO: 7120 - RNA, 19 nt, Artificial Sequence
  Description of Artificial Sequence: Synthetic oligonucleotide
gcccauagaacauuucaua

SEQ ID NO: 7121 - RNA, 19 nt, Artificial Sequence
  Description of Artificial Sequence: Synthetic oligonucleotide
ugcccauagaacauuucau

SEQ ID NO: 7122 - RNA, 19 nt, Artificial Sequence
  Description of Artificial Sequence: Synthetic oligonucleotide
cugcccauagaacauuuca

SEQ ID NO: 7123 - RNA, 19 nt, Artificial Sequence
  Description of Artificial Sequence: Synthetic oligonucleotide
ucugcccauagaacauuuc

SEQ ID NO: 7124 - RNA, 19 nt, Artificial Sequence
  Description of Artificial Sequence: Synthetic oligonucleotide
gucugcccauagaacauuu

SEQ ID NO: 7125 - RNA, 19 nt, Artificial Sequence
  Description of Artificial Sequence: Synthetic oligonucleotide
cgucugcccauagaacauu

SEQ ID NO: 7126 - RNA, 19 nt, Artificial Sequence
  Description of Artificial Sequence: Synthetic oligonucleotide
gcgucugcccauagaacau

SEQ ID NO: 7127 - RNA, 19 nt, Artificial Sequence
  Description of Artificial Sequence: Synthetic oligonucleotide
ggcgucugcccauagaaca

SEQ ID NO: 7128 - RNA, 19 nt, Artificial Sequence
  Description of Artificial Sequence: Synthetic oligonucleotide
gggcgucugcccauagaac

SEQ ID NO: 7129 - RNA, 19 nt, Artificial Sequence
  Description of Artificial Sequence: Synthetic oligonucleotide
agggcgucugcccauagaa

SEQ ID NO: 7130 - RNA, 19 nt, Artificial Sequence
  Description of Artificial Sequence: Synthetic oligonucleotide
aagggcgucugcccauaga

SEQ ID NO: 7131 - RNA, 19 nt, Artificial Sequence
  Description of Artificial Sequence: Synthetic oligonucleotide
gaagggcgucugcccauag

SEQ ID NO: 7132 - RNA, 19 nt, Artificial Sequence
  Description of Artificial Sequence: Synthetic oligonucleotide
agaagggcgucugcccaua

SEQ ID NO: 7133 - RNA, 19 nt, Artificial Sequence
  Description of Artificial Sequence: Synthetic oligonucleotide
uagaagggcgucugcccau

SEQ ID NO: 7134 - RNA, 19 nt, Artificial Sequence
  Description of Artificial Sequence: Synthetic oligonucleotide
guagaagggcgucugccca

SEQ ID NO: 7135 - RNA, 19 nt, Artificial Sequence
  Description of Artificial Sequence: Synthetic oligonucleotide
cguagaagggcgucugccc

SEQ ID NO: 7136 - RNA, 19 nt, Artificial Sequence
  Description of Artificial Sequence: Synthetic oligonucleotide
gcguagaagggcgucugcc

SEQ ID NO: 7137 - RNA, 19 nt, Artificial Sequence
  Description of Artificial Sequence: Synthetic oligonucleotide
cgcguagaagggcgucugc

SEQ ID NO: 7138 - RNA, 19 nt, Artificial Sequence
  Description of Artificial Sequence: Synthetic oligonucleotide
ccgcguagaagggcgucug

SEQ ID NO: 7139 - RNA, 19 nt, Artificial Sequence
  Description of Artificial Sequence: Synthetic oligonucleotide
uccgcguagaagggcgucu

SEQ ID NO: 7140 - RNA, 19 nt, Artificial Sequence
  Description of Artificial Sequence: Synthetic oligonucleotide
auccgcguagaagggcguc

SEQ ID NO: 7141 - RNA, 19 nt, Artificial Sequence
  Description of Artificial Sequence: Synthetic oligonucleotide
aauccgcguagaagggcgu

SEQ ID NO: 7142 - RNA, 19 nt, Artificial Sequence
  Description of Artificial Sequence: Synthetic oligonucleotide
gaauccgcguagaagggcg

SEQ ID NO: 7143 - RNA, 19 nt, Artificial Sequence
  Description of Artificial Sequence: Synthetic oligonucleotide
ggaauccgcguagaagggc

SEQ ID NO: 7144 - RNA, 19 nt, Artificial Sequence
  Description of Artificial Sequence: Synthetic oligonucleotide
uggaauccgcguagaaggg

SEQ ID NO: 7145 - RNA, 19 nt, Artificial Sequence
  Description of Artificial Sequence: Synthetic oligonucleotide
guggaauccgcguagaagg

SEQ ID NO: 7146 - RNA, 19 nt, Artificial Sequence
  Description of Artificial Sequence: Synthetic oligonucleotide
cguggaauccgcguagaag

SEQ ID NO: 7147 - RNA, 19 nt, Artificial Sequence
  Description of Artificial Sequence: Synthetic oligonucleotide
ccguggaauccgcguagaa

SEQ ID NO: 7148 - RNA, 19 nt, Artificial Sequence
  Description of Artificial Sequence: Synthetic oligonucleotide
gccguggaauccgcguaga

SEQ ID NO: 7149 - RNA, 19 nt, Artificial Sequence
  Description of Artificial Sequence: Synthetic oligonucleotide
cgccguggaauccgcguag

SEQ ID NO: 7150 - RNA, 19 nt, Artificial Sequence
  Description of Artificial Sequence: Synthetic oligonucleotide
ccgccguggaauccgcgua

SEQ ID NO: 7151 - RNA, 19 nt, Artificial Sequence
  Description of Artificial Sequence: Synthetic oligonucleotide
uccgccguggaauccgcgu

SEQ ID NO: 7152 - RNA, 19 nt, Artificial Sequence
  Description of Artificial Sequence: Synthetic oligonucleotide
cuccgccguggaauccgcg

SEQ ID NO: 7153 - RNA, 19 nt, Artificial Sequence
  Description of Artificial Sequence: Synthetic oligonucleotide
ucuccgccguggaauccgc

SEQ ID NO: 7154 - RNA, 19 nt, Artificial Sequence
  Description of Artificial Sequence: Synthetic oligonucleotide
gucuccgccguggaauccg

SEQ ID NO: 7155 - RNA, 19 nt, Artificial Sequence
  Description of Artificial Sequence: Synthetic oligonucleotide
ggucuccgccguggaaucc

SEQ ID NO: 7156 - RNA, 19 nt, Artificial Sequence
  Description of Artificial Sequence: Synthetic oligonucleotide
aggucuccgccguggaauc

SEQ ID NO: 7157 - RNA, 19 nt, Artificial Sequence
  Description of Artificial Sequence: Synthetic oligonucleotide
uaggucuccgccguggaau

SEQ ID NO: 7158 - RNA, 19 nt, Artificial Sequence
  Description of Artificial Sequence: Synthetic oligonucleotide
auaggucuccgccguggaa

SEQ ID NO: 7159 - RNA, 19 nt, Artificial Sequence
  Description of Artificial Sequence: Synthetic oligonucleotide
cauaggucuccgccgugga

SEQ ID NO: 7160 - RNA, 19 nt, Artificial Sequence
  Description of Artificial Sequence: Synthetic oligonucleotide
ccauaggucuccgccgugg

SEQ ID NO: 7161 - RNA, 19 nt, Artificial Sequence
  Description of Artificial Sequence: Synthetic oligonucleotide
gccauaggucuccgccgug

SEQ ID NO: 7162 - RNA, 19 nt, Artificial Sequence
  Description of Artificial Sequence: Synthetic oligonucleotide
ugccauaggucuccgccgu

SEQ ID NO: 7163 - RNA, 19 nt, Artificial Sequence
  Description of Artificial Sequence: Synthetic oligonucleotide
uugccauaggucuccgccg

SEQ ID NO: 7164 - RNA, 19 nt, Artificial Sequence
  Description of Artificial Sequence: Synthetic oligonucleotide
cuugccauaggucuccgcc

SEQ ID NO: 7165 - RNA, 19 nt, Artificial Sequence
  Description of Artificial Sequence: Synthetic oligonucleotide
ucuugccauaggucuccgc

SEQ ID NO: 7166 - RNA, 19 nt, Artificial Sequence
  Description of Artificial Sequence: Synthetic oligonucleotide
aucuugccauaggucuccg

SEQ ID NO: 7167 - RNA, 19 nt, Artificial Sequence
  Description of Artificial Sequence: Synthetic oligonucleotide
gaucuugccauaggucucc

SEQ ID NO: 7168 - RNA, 19 nt, Artificial Sequence
  Description of Artificial Sequence: Synthetic oligonucleotide
cgaucuugccauaggucuc

SEQ ID NO: 7169 - RNA, 19 nt, Artificial Sequence
  Description of Artificial Sequence: Synthetic oligonucleotide
acgaucuugccauaggucu

SEQ ID NO: 7170 - RNA, 19 nt, Artificial Sequence
  Description of Artificial Sequence: Synthetic oligonucleotide
gacgaucuugccauagguc

SEQ ID NO: 7171 - RNA, 19 nt, Artificial Sequence
  Description of Artificial Sequence: Synthetic oligonucleotide
ggacgaucuugccauaggu

SEQ ID NO: 7172 - RNA, 19 nt, Artificial Sequence
  Description of Artificial Sequence: Synthetic oligonucleotide
uggacgaucuugccauagg

SEQ ID NO: 7173 - RNA, 19 nt, Artificial Sequence
  Description of Artificial Sequence: Synthetic oligonucleotide
guggacgaucuugccauag

SEQ ID NO: 7174 - RNA, 19 nt, Artificial Sequence
  Description of Artificial Sequence: Synthetic oligonucleotide
aguggacgaucuugccaua

SEQ ID NO: 7175 - RNA, 19 nt, Artificial Sequence
  Description of Artificial Sequence: Synthetic oligonucleotide
uaguggacgaucuugccau

SEQ ID NO: 7176 - RNA, 19 nt, Artificial Sequence
  Description of Artificial Sequence: Synthetic oligonucleotide
guaguggacgaucuugcca

SEQ ID NO: 7177 - RNA, 19 nt, Artificial Sequence
  Description of Artificial Sequence: Synthetic oligonucleotide
uguaguggacgaucuugcc

SEQ ID NO: 7178 - RNA, 19 nt, Artificial Sequence
  Description of Artificial Sequence: Synthetic oligonucleotide
uuguaguggacgaucuugc

SEQ ID NO: 7179 - RNA, 19 nt, Artificial Sequence
  Description of Artificial Sequence: Synthetic oligonucleotide
cuuguaguggacgaucuug

SEQ ID NO: 7180 - RNA, 19 nt, Artificial Sequence
  Description of Artificial Sequence: Synthetic oligonucleotide
ccuuguaguggacgaucuu

SEQ ID NO: 7181 - RNA, 19 nt, Artificial Sequence
  Description of Artificial Sequence: Synthetic oligonucleotide
uccuuguaguggacgaucu

SEQ ID NO: 7182 - RNA, 19 nt, Artificial Sequence
  Description of Artificial Sequence: Synthetic oligonucleotide
cuccuuguaguggacgauc

SEQ ID NO: 7183 - RNA, 19 nt, Artificial Sequence
  Description of Artificial Sequence: Synthetic oligonucleotide
gcuccuuguaguggacgau

SEQ ID NO: 7184 - RNA, 19 nt, Artificial Sequence
  Description of Artificial Sequence: Synthetic oligonucleotide
ugcuccuuguaguggacga

SEQ ID NO: 7185 - RNA, 19 nt, Artificial Sequence
  Description of Artificial Sequence: Synthetic oligonucleotide
gugcuccuuguaguggacg

SEQ ID NO: 7186 - RNA, 19 nt, Artificial Sequence
  Description of Artificial Sequence: Synthetic oligonucleotide
ggugcuccuuguaguggac

SEQ ID NO: 7187 - RNA, 19 nt, Artificial Sequence
  Description of Artificial Sequence: Synthetic oligonucleotide
aggugcuccuuguagugga

SEQ ID NO: 7188 - RNA, 19 nt, Artificial Sequence
  Description of Artificial Sequence: Synthetic oligonucleotide
gaggugcuccuuguagugg

SEQ ID NO: 7189 - RNA, 19 nt, Artificial Sequence
  Description of Artificial Sequence: Synthetic oligonucleotide
agaggugcuccuuguagug

SEQ ID NO: 7190 - RNA, 19 nt, Artificial Sequence
  Description of Artificial Sequence: Synthetic oligonucleotide
gagaggugcuccuuguagu

SEQ ID NO: 7191 - RNA, 19 nt, Artificial Sequence
  Description of Artificial Sequence: Synthetic oligonucleotide
agagaggugcuccuuguag

SEQ ID NO: 7192 - RNA, 19 nt, Artificial Sequence
  Description of Artificial Sequence: Synthetic oligonucleotide
gagagaggugcuccuugua

SEQ ID NO: 7193 - RNA, 19 nt, Artificial Sequence
  Description of Artificial Sequence: Synthetic oligonucleotide
agagagaggugcuccuugu

SEQ ID NO: 7194 - RNA, 19 nt, Artificial Sequence
  Description of Artificial Sequence: Synthetic oligonucleotide
cagagagaggugcuccuug

SEQ ID NO: 7195 - RNA, 19 nt, Artificial Sequence
  Description of Artificial Sequence: Synthetic oligonucleotide
gcagagagaggugcuccuu

SEQ ID NO: 7196 - RNA, 19 nt, Artificial Sequence
  Description of Artificial Sequence: Synthetic oligonucleotide
ggcagagagaggugcuccu

SEQ ID NO: 7197 - RNA, 19 nt, Artificial Sequence
  Description of Artificial Sequence: Synthetic oligonucleotide
cggcagagagaggugcucc

SEQ ID NO: 7198 - RNA, 19 nt, Artificial Sequence
  Description of Artificial Sequence: Synthetic oligonucleotide
gcggcagagagaggugcuc

SEQ ID NO: 7199 - RNA, 19 nt, Artificial Sequence
  Description of Artificial Sequence: Synthetic oligonucleotide
agcggcagagagaggugcu

SEQ ID NO: 7200 - RNA, 19 nt, Artificial Sequence
  Description of Artificial Sequence: Synthetic oligonucleotide
cagcggcagagagaggugc

SEQ ID NO: 7201 - RNA, 19 nt, Artificial Sequence
  Description of Artificial Sequence: Synthetic oligonucleotide
ccagcggcagagagaggug

SEQ ID NO: 7202 - RNA, 19 nt, Artificial Sequence
  Description of Artificial Sequence: Synthetic oligonucleotide
accagcggcagagagaggu

SEQ ID NO: 7203 - RNA, 19 nt, Artificial Sequence
  Description of Artificial Sequence: Synthetic oligonucleotide
caccagcggcagagagagg

SEQ ID NO: 7204 - RNA, 19 nt, Artificial Sequence
  Description of Artificial Sequence: Synthetic oligonucleotide
ccaccagcggcagagagag

SEQ ID NO: 7205 - RNA, 19 nt, Artificial Sequence
  Description of Artificial Sequence: Synthetic oligonucleotide
uccaccagcggcagagaga

SEQ ID NO: 7206 - RNA, 19 nt, Artificial Sequence
  Description of Artificial Sequence: Synthetic oligonucleotide
guccaccagcggcagagag

SEQ ID NO: 7207 - RNA, 19 nt, Artificial Sequence
  Description of Artificial Sequence: Synthetic oligonucleotide
cguccaccagcggcagaga

SEQ ID NO: 7208 - RNA, 19 nt, Artificial Sequence
  Description of Artificial Sequence: Synthetic oligonucleotide
ucguccaccagcggcagag

SEQ ID NO: 7209 - RNA, 19 nt, Artificial Sequence
  Description of Artificial Sequence: Synthetic oligonucleotide
uucguccaccagcggcaga

SEQ ID NO: 7210 - RNA, 19 nt, Artificial Sequence
  Description of Artificial Sequence: Synthetic oligonucleotide
cuucguccaccagcggcag

SEQ ID NO: 7211 - RNA, 19 nt, Artificial Sequence
  Description of Artificial Sequence: Synthetic oligonucleotide
ccuucguccaccagcggca

SEQ ID NO: 7212 - RNA, 19 nt, Artificial Sequence
  Description of Artificial Sequence: Synthetic oligonucleotide
cccuucguccaccagcggc

SEQ ID NO: 7213 - RNA, 19 nt, Artificial Sequence
  Description of Artificial Sequence: Synthetic oligonucleotide
ccccuucguccaccagcgg

SEQ ID NO: 7214 - RNA, 19 nt, Artificial Sequence
  Description of Artificial Sequence: Synthetic oligonucleotide
accccuucguccaccagcg

SEQ ID NO: 7215 - RNA, 19 nt, Artificial Sequence
  Description of Artificial Sequence: Synthetic oligonucleotide
gaccccuucguccaccagc

SEQ ID NO: 7216 - RNA, 19 nt, Artificial Sequence
  Description of Artificial Sequence: Synthetic oligonucleotide
ggaccccuucguccaccag

SEQ ID NO: 7217 - RNA, 19 nt, Artificial Sequence
  Description of Artificial Sequence: Synthetic oligonucleotide
gggaccccuucguccacca

SEQ ID NO: 7218 - RNA, 19 nt, Artificial Sequence
  Description of Artificial Sequence: Synthetic oligonucleotide
agggaccccuucguccacc

SEQ ID NO: 7219 - RNA, 19 nt, Artificial Sequence
  Description of Artificial Sequence: Synthetic oligonucleotide
cagggaccccuucguccac

SEQ ID NO: 7220 - RNA, 19 nt, Artificial Sequence
  Description of Artificial Sequence: Synthetic oligonucleotide
ucagggaccccuucgucca

SEQ ID NO: 7221 - RNA, 19 nt, Artificial Sequence
  Description of Artificial Sequence: Synthetic oligonucleotide
cucagggaccccuucgucc

SEQ ID NO: 7222 - RNA, 19 nt, Artificial Sequence
  Description of Artificial Sequence: Synthetic oligonucleotide
ccucagggaccccuucguc

SEQ ID NO: 7223 - RNA, 19 nt, Artificial Sequence
  Description of Artificial Sequence: Synthetic oligonucleotide
uccucagggaccccuucgu

SEQ ID NO: 7224 - RNA, 19 nt, Artificial Sequence
  Description of Artificial Sequence: Synthetic oligonucleotide
cuccucagggaccccuucg

SEQ ID NO: 7225 - RNA, 19 nt, Artificial Sequence
  Description of Artificial Sequence: Synthetic oligonucleotide
ccuccucagggaccccuuc

SEQ ID NO: 7226 - RNA, 19 nt, Artificial Sequence
  Description of Artificial Sequence: Synthetic oligonucleotide
gccuccucagggaccccuu

SEQ ID NO: 7227 - RNA, 19 nt, Artificial Sequence
  Description of Artificial Sequence: Synthetic oligonucleotide
agccuccucagggaccccu

SEQ ID NO: 7228 - RNA, 19 nt, Artificial Sequence
  Description of Artificial Sequence: Synthetic oligonucleotide
gagccuccucagggacccc

SEQ ID NO: 7229 - RNA, 19 nt, Artificial Sequence
  Description of Artificial Sequence: Synthetic oligonucleotide
cgagccuccucagggaccc

SEQ ID NO: 7230 - RNA, 19 nt, Artificial Sequence
  Description of Artificial Sequence: Synthetic oligonucleotide
ucgagccuccucagggacc

SEQ ID NO: 7231 - RNA, 19 nt, Artificial Sequence
  Description of Artificial Sequence: Synthetic oligonucleotide
cucgagccuccucagggac

SEQ ID NO: 7232 - RNA, 19 nt, Artificial Sequence
  Description of Artificial Sequence: Synthetic oligonucleotide
ucucgagccuccucaggga

SEQ ID NO: 7233 - RNA, 19 nt, Artificial Sequence
  Description of Artificial Sequence: Synthetic oligonucleotide
gucucgagccuccucaggg

SEQ ID NO: 7234 - RNA, 19 nt, Artificial Sequence
  Description of Artificial Sequence: Synthetic oligonucleotide
agucucgagccuccucagg

SEQ ID NO: 7235 - RNA, 19 nt, Artificial Sequence
  Description of Artificial Sequence: Synthetic oligonucleotide
aagucucgagccuccucag

SEQ ID NO: 7236 - RNA, 19 nt, Artificial Sequence
  Description of Artificial Sequence: Synthetic oligonucleotide
gaagucucgagccuccuca

SEQ ID NO: 7237 - RNA, 19 nt, Artificial Sequence
  Description of Artificial Sequence: Synthetic oligonucleotide
ugaagucucgagccuccuc

SEQ ID NO: 7238 - RNA, 19 nt, Artificial Sequence
  Description of Artificial Sequence: Synthetic oligonucleotide
augaagucucgagccuccu

SEQ ID NO: 7239 - RNA, 19 nt, Artificial Sequence
  Description of Artificial Sequence: Synthetic oligonucleotide
aaugaagucucgagccucc

SEQ ID NO: 7240 - RNA, 19 nt, Artificial Sequence
  Description of Artificial Sequence: Synthetic oligonucleotide
gaaugaagucucgagccuc

SEQ ID NO: 7241 - RNA, 19 nt, Artificial Sequence
  Description of Artificial Sequence: Synthetic oligonucleotide
ugaaugaagucucgagccu

SEQ ID NO: 7242 - RNA, 19 nt, Artificial Sequence
  Description of Artificial Sequence: Synthetic oligonucleotide
cugaaugaagucucgagcc

SEQ ID NO: 7243 - RNA, 19 nt, Artificial Sequence
  Description of Artificial Sequence: Synthetic oligonucleotide
gcugaaugaagucucgagc

SEQ ID NO: 7244 - RNA, 19 nt, Artificial Sequence
  Description of Artificial Sequence: Synthetic oligonucleotide
cgcugaaugaagucucgag

SEQ ID NO: 7245 - RNA, 19 nt, Artificial Sequence
  Description of Artificial Sequence: Synthetic oligonucleotide
ccgcugaaugaagucucga

SEQ ID NO: 7246 - RNA, 19 nt, Artificial Sequence
  Description of Artificial Sequence: Synthetic oligonucleotide
accgcugaaugaagucucg

SEQ ID NO: 7247 - RNA, 19 nt, Artificial Sequence
  Description of Artificial Sequence: Synthetic oligonucleotide
aaccgcugaaugaagucuc

SEQ ID NO: 7248 - RNA, 19 nt, Artificial Sequence
  Description of Artificial Sequence: Synthetic oligonucleotide
caaccgcugaaugaagucu

SEQ ID NO: 7249 - RNA, 19 nt, Artificial Sequence
  Description of Artificial Sequence: Synthetic oligonucleotide
gcaaccgcugaaugaaguc

SEQ ID NO: 7250 - RNA, 19 nt, Artificial Sequence
  Description of Artificial Sequence: Synthetic oligonucleotide
agcaaccgcugaaugaagu

SEQ ID NO: 7251 - RNA, 19 nt, Artificial Sequence
  Description of Artificial Sequence: Synthetic oligonucleotide
cagcaaccgcugaaugaag

SEQ ID NO: 7252 - RNA, 19 nt, Artificial Sequence
  Description of Artificial Sequence: Synthetic oligonucleotide
acagcaaccgcugaaugaa

SEQ ID NO: 7253 - RNA, 19 nt, Artificial Sequence
  Description of Artificial Sequence: Synthetic oligonucleotide
cacagcaaccgcugaauga

SEQ ID NO: 7254 - RNA, 19 nt, Artificial Sequence
  Description of Artificial Sequence: Synthetic oligonucleotide
acacagcaaccgcugaaug

SEQ ID NO: 7255 - RNA, 19 nt, Artificial Sequence
  Description of Artificial Sequence: Synthetic oligonucleotide
gacacagcaaccgcugaau

SEQ ID NO: 7256 - RNA, 19 nt, Artificial Sequence
  Description of Artificial Sequence: Synthetic oligonucleotide
ggacacagcaaccgcugaa

SEQ ID NO: 7257 - RNA, 19 nt, Artificial Sequence
  Description of Artificial Sequence: Synthetic oligonucleotide
gggacacagcaaccgcuga

SEQ ID NO: 7258 - RNA, 19 nt, Artificial Sequence
  Description of Artificial Sequence: Synthetic oligonucleotide
ggggacacagcaaccgcug

SEQ ID NO: 7259 - RNA, 19 nt, Artificial Sequence
  Description of Artificial Sequence: Synthetic oligonucleotide
gggggacacagcaaccgcu

SEQ ID NO: 7260 - RNA, 19 nt, Artificial Sequence
  Description of Artificial Sequence: Synthetic oligonucleotide
cgggggacacagcaaccgc

SEQ ID NO: 7261 - RNA, 19 nt, Artificial Sequence
  Description of Artificial Sequence: Synthetic oligonucleotide
ccgggggacacagcaaccg

SEQ ID NO: 7262 - RNA, 19 nt, Artificial Sequence
  Description of Artificial Sequence: Synthetic oligonucleotide
uccgggggacacagcaacc

SEQ ID NO: 7263 - RNA, 19 nt, Artificial Sequence
  Description of Artificial Sequence: Synthetic oligonucleotide
cuccgggggacacagcaac

SEQ ID NO: 7264 - RNA, 19 nt, Artificial Sequence
  Description of Artificial Sequence: Synthetic oligonucleotide
ucuccgggggacacagcaa

SEQ ID NO: 7265 - RNA, 19 nt, Artificial Sequence
  Description of Artificial Sequence: Synthetic oligonucleotide
gucuccgggggacacagca

SEQ ID NO: 7266 - RNA, 19 nt, Artificial Sequence
  Description of Artificial Sequence: Synthetic oligonucleotide
ugucuccgggggacacagc

SEQ ID NO: 7267 - RNA, 19 nt, Artificial Sequence
  Description of Artificial Sequence: Synthetic oligonucleotide
gugucuccgggggacacag

SEQ ID NO: 7268 - RNA, 19 nt, Artificial Sequence
  Description of Artificial Sequence: Synthetic oligonucleotide
cgugucuccgggggacaca

SEQ ID NO: 7269 - RNA, 19 nt, Artificial Sequence
  Description of Artificial Sequence: Synthetic oligonucleotide
ccgugucuccgggggacac

SEQ ID NO: 7270 - RNA, 19 nt, Artificial Sequence
  Description of Artificial Sequence: Synthetic oligonucleotide
gccgugucuccgggggaca

SEQ ID NO: 7271 - RNA, 19 nt, Artificial Sequence
  Description of Artificial Sequence: Synthetic oligonucleotide
agccgugucuccgggggac

SEQ ID NO: 7272 - RNA, 19 nt, Artificial Sequence
  Description of Artificial Sequence: Synthetic oligonucleotide
cagccgugucuccggggga

SEQ ID NO: 7273 - RNA, 19 nt, Artificial Sequence
  Description of Artificial Sequence: Synthetic oligonucleotide
ccagccgugucuccggggg

SEQ ID NO: 7274 - RNA, 19 nt, Artificial Sequence
  Description of Artificial Sequence: Synthetic oligonucleotide
cccagccgugucuccgggg

SEQ ID NO: 7275 - RNA, 19 nt, Artificial Sequence
  Description of Artificial Sequence: Synthetic oligonucleotide
gcccagccgugucuccggg

SEQ ID NO: 7276 - RNA, 19 nt, Artificial Sequence
  Description of Artificial Sequence: Synthetic oligonucleotide
ggcccagccgugucuccgg

SEQ ID NO: 7277 - RNA, 19 nt, Artificial Sequence
  Description of Artificial Sequence: Synthetic oligonucleotide
cggcccagccgugucuccg

SEQ ID NO: 7278 - RNA, 19 nt, Artificial Sequence
  Description of Artificial Sequence: Synthetic oligonucleotide
ccggcccagccgugucucc

SEQ ID NO: 7279 - RNA, 19 nt, Artificial Sequence
  Description of Artificial Sequence: Synthetic oligonucleotide
cccggcccagccgugucuc

SEQ ID NO: 7280 - RNA, 19 nt, Artificial Sequence
  Description of Artificial Sequence: Synthetic oligonucleotide
ccccggcccagccgugucu

SEQ ID NO: 7281 - RNA, 19 nt, Artificial Sequence
  Description of Artificial Sequence: Synthetic oligonucleotide
accccggcccagccguguc

SEQ ID NO: 7282 - RNA, 19 nt, Artificial Sequence
  Description of Artificial Sequence: Synthetic oligonucleotide
caccccggcccagccgugu

SEQ ID NO: 7283 - RNA, 19 nt, Artificial Sequence
  Description of Artificial Sequence: Synthetic oligonucleotide
ccaccccggcccagccgug

SEQ ID NO: 7284 - RNA, 19 nt, Artificial Sequence
  Description of Artificial Sequence: Synthetic oligonucleotide
uccaccccggcccagccgu

SEQ ID NO: 7285 - RNA, 19 nt, Artificial Sequence
  Description of Artificial Sequence: Synthetic oligonucleotide
cuccaccccggcccagccg

SEQ ID NO: 7286 - RNA, 19 nt, Artificial Sequence
  Description of Artificial Sequence: Synthetic oligonucleotide
gcuccaccccggcccagcc

SEQ ID NO: 7287 - RNA, 19 nt, Artificial Sequence
  Description of Artificial Sequence: Synthetic oligonucleotide
ugcuccaccccggcccagc

SEQ ID NO: 7288 - RNA, 19 nt, Artificial Sequence
  Description of Artificial Sequence: Synthetic oligonucleotide
cugcuccaccccggcccag

SEQ ID NO: 7289 - RNA, 19 nt, Artificial Sequence
  Description of Artificial Sequence: Synthetic oligonucleotide
ccugcuccaccccggccca

SEQ ID NO: 7290 - RNA, 19 nt, Artificial Sequence
  Description of Artificial Sequence: Synthetic oligonucleotide
gccugcuccaccccggccc

SEQ ID NO: 7291 - RNA, 19 nt, Artificial Sequence
  Description of Artificial Sequence: Synthetic oligonucleotide
cgccugcuccaccccggcc

SEQ ID NO: 7292 - RNA, 19 nt, Artificial Sequence
  Description of Artificial Sequence: Synthetic oligonucleotide
ucgccugcuccaccccggc

SEQ ID NO: 7293 - RNA, 19 nt, Artificial Sequence
  Description of Artificial Sequence: Synthetic oligonucleotide
gucgccugcuccaccccgg

SEQ ID NO: 7294 - RNA, 19 nt, Artificial Sequence
  Description of Artificial Sequence: Synthetic oligonucleotide
agucgccugcuccaccccg

SEQ ID NO: 7295 - RNA, 19 nt, Artificial Sequence
  Description of Artificial Sequence: Synthetic oligonucleotide
aagucgccugcuccacccc

SEQ ID NO: 7296 - RNA, 19 nt, Artificial Sequence
  Description of Artificial Sequence: Synthetic oligonucleotide
gaagucgccugcuccaccc

SEQ ID NO: 7297 - RNA, 19 nt, Artificial Sequence
  Description of Artificial Sequence: Synthetic oligonucleotide
ggaagucgccugcuccacc

SEQ ID NO: 7298 - RNA, 19 nt, Artificial Sequence
  Description of Artificial Sequence: Synthetic oligonucleotide
cggaagucgccugcuccac

SEQ ID NO: 7299 - RNA, 19 nt, Artificial Sequence
  Description of Artificial Sequence: Synthetic oligonucleotide
ccggaagucgccugcucca

SEQ ID NO: 7300 - RNA, 19 nt, Artificial Sequence
  Description of Artificial Sequence: Synthetic oligonucleotide
uccggaagucgccugcucc

SEQ ID NO: 7301 - RNA, 19 nt, Artificial Sequence
  Description of Artificial Sequence: Synthetic oligonucleotide
guccggaagucgccugcuc

SEQ ID NO: 7302 - RNA, 19 nt, Artificial Sequence
  Description of Artificial Sequence: Synthetic oligonucleotide
uguccggaagucgccugcu

SEQ ID NO: 7303 - RNA, 19 nt, Artificial Sequence
  Description of Artificial Sequence: Synthetic oligonucleotide
guguccggaagucgccugc

SEQ ID NO: 7304 - RNA, 19 nt, Artificial Sequence
  Description of Artificial Sequence: Synthetic oligonucleotide
uguguccggaagucgccug

SEQ ID NO: 7305 - RNA, 19 nt, Artificial Sequence
  Description of Artificial Sequence: Synthetic oligonucleotide
auguguccggaagucgccu

SEQ ID NO: 7306 - RNA, 19 nt, Artificial Sequence
  Description of Artificial Sequence: Synthetic oligonucleotide
gauguguccggaagucgcc

SEQ ID NO: 7307 - RNA, 19 nt, Artificial Sequence
  Description of Artificial Sequence: Synthetic oligonucleotide
ggauguguccggaagucgc

SEQ ID NO: 7308 - RNA, 19 nt, Artificial Sequence
  Description of Artificial Sequence: Synthetic oligonucleotide
gggauguguccggaagucg

SEQ ID NO: 7309 - RNA, 19 nt, Artificial Sequence
  Description of Artificial Sequence: Synthetic oligonucleotide
agggauguguccggaaguc

SEQ ID NO: 7310 - RNA, 19 nt, Artificial Sequence
  Description of Artificial Sequence: Synthetic oligonucleotide
aagggauguguccggaagu

SEQ ID NO: 7311 - RNA, 19 nt, Artificial Sequence
  Description of Artificial Sequence: Synthetic oligonucleotide
gaagggauguguccggaag

SEQ ID NO: 7312 - RNA, 19 nt, Artificial Sequence
  Description of Artificial Sequence: Synthetic oligonucleotide
agaagggauguguccggaa

SEQ ID NO: 7313 - RNA, 19 nt, Artificial Sequence
  Description of Artificial Sequence: Synthetic oligonucleotide
aagaagggauguguccgga

SEQ ID NO: 7314 - RNA, 19 nt, Artificial Sequence
  Description of Artificial Sequence: Synthetic oligonucleotide
gaagaagggauguguccgg

SEQ ID NO: 7315 - RNA, 19 nt, Artificial Sequence
  Description of Artificial Sequence: Synthetic oligonucleotide
agaagaagggauguguccg

SEQ ID NO: 7316 - RNA, 19 nt, Artificial Sequence
  Description of Artificial Sequence: Synthetic oligonucleotide
aagaagaagggaugugucc

SEQ ID NO: 7317 - RNA, 19 nt, Artificial Sequence
  Description of Artificial Sequence: Synthetic oligonucleotide
aaagaagaagggauguguc

SEQ ID NO: 7318 - RNA, 19 nt, Artificial Sequence
  Description of Artificial Sequence: Synthetic oligonucleotide
caaagaagaagggaugugu

SEQ ID NO: 7319 - RNA, 19 nt, Artificial Sequence
  Description of Artificial Sequence: Synthetic oligonucleotide
ccaaagaagaagggaugug

SEQ ID NO: 7320 - RNA, 19 nt, Artificial Sequence
  Description of Artificial Sequence: Synthetic oligonucleotide
gccaaagaagaagggaugu

SEQ ID NO: 7321 - RNA, 19 nt, Artificial Sequence
  Description of Artificial Sequence: Synthetic oligonucleotide
ggccaaagaagaagggaug

SEQ ID NO: 7322 - RNA, 19 nt, Artificial Sequence
  Description of Artificial Sequence: Synthetic oligonucleotide
aggccaaagaagaagggau

SEQ ID NO: 7323 - RNA, 19 nt, Artificial Sequence
  Description of Artificial Sequence: Synthetic oligonucleotide
gaggccaaagaagaaggga

SEQ ID NO: 7324 - RNA, 19 nt, Artificial Sequence
  Description of Artificial Sequence: Synthetic oligonucleotide
cgaggccaaagaagaaggg

SEQ ID NO: 7325 - RNA, 19 nt, Artificial Sequence
  Description of Artificial Sequence: Synthetic oligonucleotide
ucgaggccaaagaagaagg

SEQ ID NO: 7326 - RNA, 19 nt, Artificial Sequence
  Description of Artificial Sequence: Synthetic oligonucleotide
gucgaggccaaagaagaag

SEQ ID NO: 7327 - RNA, 19 nt, Artificial Sequence
  Description of Artificial Sequence: Synthetic oligonucleotide
agucgaggccaaagaagaa

SEQ ID NO: 7328 - RNA, 19 nt, Artificial Sequence
  Description of Artificial Sequence: Synthetic oligonucleotide
cagucgaggccaaagaaga

SEQ ID NO: 7329 - RNA, 19 nt, Artificial Sequence
  Description of Artificial Sequence: Synthetic oligonucleotide
ccagucgaggccaaagaag

SEQ ID NO: 7330 - RNA, 19 nt, Artificial Sequence
  Description of Artificial Sequence: Synthetic oligonucleotide
cccagucgaggccaaagaa

SEQ ID NO: 7331 - RNA, 19 nt, Artificial Sequence
  Description of Artificial Sequence: Synthetic oligonucleotide
ucccagucgaggccaaaga

SEQ ID NO: 7332 - RNA, 19 nt, Artificial Sequence
  Description of Artificial Sequence: Synthetic oligonucleotide
aucccagucgaggccaaag

SEQ ID NO: 7333 - RNA, 19 nt, Artificial Sequence
  Description of Artificial Sequence: Synthetic oligonucleotide
caucccagucgaggccaaa

SEQ ID NO: 7334 - RNA, 19 nt, Artificial Sequence
  Description of Artificial Sequence: Synthetic oligonucleotide
ccaucccagucgaggccaa

SEQ ID NO: 7335 - RNA, 19 nt, Artificial Sequence
  Description of Artificial Sequence: Synthetic oligonucleotide
accaucccagucgaggcca

SEQ ID NO: 7336 - RNA, 19 nt, Artificial Sequence
  Description of Artificial Sequence: Synthetic oligonucleotide
gaccaucccagucgaggcc

SEQ ID NO: 7337 - RNA, 19 nt, Artificial Sequence
  Description of Artificial Sequence: Synthetic oligonucleotide
agaccaucccagucgaggc

SEQ ID NO: 7338 - RNA, 19 nt, Artificial Sequence
  Description of Artificial Sequence: Synthetic oligonucleotide
gagaccaucccagucgagg

SEQ ID NO: 7339 - RNA, 19 nt, Artificial Sequence
  Description of Artificial Sequence: Synthetic oligonucleotide
ggagaccaucccagucgag

SEQ ID NO: 7340 - RNA, 19 nt, Artificial Sequence
  Description of Artificial Sequence: Synthetic oligonucleotide
cggagaccaucccagucga

SEQ ID NO: 7341 - RNA, 19 nt, Artificial Sequence
  Description of Artificial Sequence: Synthetic oligonucleotide
ccggagaccaucccagucg

SEQ ID NO: 7342 - RNA, 19 nt, Artificial Sequence
  Description of Artificial Sequence: Synthetic oligonucleotide
cccggagaccaucccaguc

SEQ ID NO: 7343 - RNA, 19 nt, Artificial Sequence
  Description of Artificial Sequence: Synthetic oligonucleotide
ucccggagaccaucccagu

SEQ ID NO: 7344 - RNA, 19 nt, Artificial Sequence
  Description of Artificial Sequence: Synthetic oligonucleotide
gucccggagaccaucccag

SEQ ID NO: 7345 - RNA, 19 nt, Artificial Sequence
  Description of Artificial Sequence: Synthetic oligonucleotide
ugucccggagaccauccca

SEQ ID NO: 7346 - RNA, 19 nt, Artificial Sequence
  Description of Artificial Sequence: Synthetic oligonucleotide
cugucccggagaccauccc

SEQ ID NO: 7347 - RNA, 19 nt, Artificial Sequence
  Description of Artificial Sequence: Synthetic oligonucleotide
gcugucccggagaccaucc

SEQ ID NO: 7348 - RNA, 19 nt, Artificial Sequence
  Description of Artificial Sequence: Synthetic oligonucleotide
cgcugucccggagaccauc

SEQ ID NO: 7349 - RNA, 19 nt, Artificial Sequence
  Description of Artificial Sequence: Synthetic oligonucleotide
acgcugucccggagaccau

SEQ ID NO: 7350 - RNA, 19 nt, Artificial Sequence
  Description of Artificial Sequence: Synthetic oligonucleotide
cacgcugucccggagacca

SEQ ID NO: 7351 - RNA, 19 nt, Artificial Sequence
  Description of Artificial Sequence: Synthetic oligonucleotide
gcacgcugucccggagacc

SEQ ID NO: 7352 - RNA, 19 nt, Artificial Sequence
  Description of Artificial Sequence: Synthetic oligonucleotide
ggcacgcugucccggagac

SEQ ID NO: 7353 - RNA, 19 nt, Artificial Sequence
  Description of Artificial Sequence: Synthetic oligonucleotide
gggcacgcugucccggaga

SEQ ID NO: 7354 - RNA, 19 nt, Artificial Sequence
  Description of Artificial Sequence: Synthetic oligonucleotide
ggggcacgcugucccggag

SEQ ID NO: 7355 - RNA, 19 nt, Artificial Sequence
  Description of Artificial Sequence: Synthetic oligonucleotide
gggggcacgcugucccgga

SEQ ID NO: 7356 - RNA, 19 nt, Artificial Sequence
  Description of Artificial Sequence: Synthetic oligonucleotide
ggggggcacgcugucccgg

SEQ ID NO: 7357 - RNA, 19 nt, Artificial Sequence
  Description of Artificial Sequence: Synthetic oligonucleotide
aggggggcacgcugucccg

SEQ ID NO: 7358 - RNA, 19 nt, Artificial Sequence
  Description of Artificial Sequence: Synthetic oligonucleotide
aaggggggcacgcuguccc

SEQ ID NO: 7359 - RNA, 19 nt, Artificial Sequence
  Description of Artificial Sequence: Synthetic oligonucleotide
aaaggggggcacgcugucc

SEQ ID NO: 7360 - RNA, 19 nt, Artificial Sequence
  Description of Artificial Sequence: Synthetic oligonucleotide
uaaaggggggcacgcuguc

SEQ ID NO: 7361 - RNA, 19 nt, Artificial Sequence
  Description of Artificial Sequence: Synthetic oligonucleotide
guaaaggggggcacgcugu

SEQ ID NO: 7362 - RNA, 19 nt, Artificial Sequence
  Description of Artificial Sequence: Synthetic oligonucleotide
uguaaaggggggcacgcug

SEQ ID NO: 7363 - RNA, 19 nt, Artificial Sequence
  Description of Artificial Sequence: Synthetic oligonucleotide
guguaaaggggggcacgcu

SEQ ID NO: 7364 - RNA, 19 nt, Artificial Sequence
  Description of Artificial Sequence: Synthetic oligonucleotide
gguguaaaggggggcacgc

SEQ ID NO: 7365 - RNA, 19 nt, Artificial Sequence
  Description of Artificial Sequence: Synthetic oligonucleotide
cgguguaaaggggggcacg

SEQ ID NO: 7366 - RNA, 19 nt, Artificial Sequence
  Description of Artificial Sequence: Synthetic oligonucleotide
ccgguguaaaggggggcac

SEQ ID NO: 7367 - RNA, 19 nt, Artificial Sequence
  Description of Artificial Sequence: Synthetic oligonucleotide
uccgguguaaaggggggca

SEQ ID NO: 7368 - RNA, 19 nt, Artificial Sequence
  Description of Artificial Sequence: Synthetic oligonucleotide
auccgguguaaaggggggc

SEQ ID NO: 7369 - RNA, 19 nt, Artificial Sequence
  Description of Artificial Sequence: Synthetic oligonucleotide
aauccgguguaaagggggg

SEQ ID NO: 7370 - RNA, 19 nt, Artificial Sequence
  Description of Artificial Sequence: Synthetic oligonucleotide
aaauccgguguaaaggggg

SEQ ID NO: 7371 - RNA, 19 nt, Artificial Sequence
  Description of Artificial Sequence: Synthetic oligonucleotide
gaaauccgguguaaagggg

SEQ ID NO: 7372 - RNA, 19 nt, Artificial Sequence
  Description of Artificial Sequence: Synthetic oligonucleotide
cgaaauccgguguaaaggg

SEQ ID NO: 7373 - RNA, 19 nt, Artificial Sequence
  Description of Artificial Sequence: Synthetic oligonucleotide
ucgaaauccgguguaaagg

SEQ ID NO: 7374 - RNA, 19 nt, Artificial Sequence
  Description of Artificial Sequence: Synthetic oligonucleotide
uucgaaauccgguguaaag

SEQ ID NO: 7375 - RNA, 19 nt, Artificial Sequence
  Description of Artificial Sequence: Synthetic oligonucleotide
cuucgaaauccgguguaaa

SEQ ID NO: 7376 - RNA, 19 nt, Artificial Sequence
  Description of Artificial Sequence: Synthetic oligonucleotide
ccuucgaaauccgguguaa

SEQ ID NO: 7377 - RNA, 19 nt, Artificial Sequence
  Description of Artificial Sequence: Synthetic oligonucleotide
accuucgaaauccggugua

SEQ ID NO: 7378 - RNA, 19 nt, Artificial Sequence
  Description of Artificial Sequence: Synthetic oligonucleotide
caccuucgaaauccggugu

SEQ ID NO: 7379 - RNA, 19 nt, Artificial Sequence
  Description of Artificial Sequence: Synthetic oligonucleotide
gcaccuucgaaauccggug

SEQ ID NO: 7380 - RNA, 19 nt, Artificial Sequence
  Description of Artificial Sequence: Synthetic oligonucleotide
ggcaccuucgaaauccggu

SEQ ID NO: 7381 - RNA, 19 nt, Artificial Sequence
  Description of Artificial Sequence: Synthetic oligonucleotide
uggcaccuucgaaauccgg

SEQ ID NO: 7382 - RNA, 19 nt, Artificial Sequence
  Description of Artificial Sequence: Synthetic oligonucleotide
guggcaccuucgaaauccg

SEQ ID NO: 7383 - RNA, 19 nt, Artificial Sequence
  Description of Artificial Sequence: Synthetic oligonucleotide
gguggcaccuucgaaaucc

SEQ ID NO: 7384 - RNA, 19 nt, Artificial Sequence
  Description of Artificial Sequence: Synthetic oligonucleotide
cgguggcaccuucgaaauc

SEQ ID NO: 7385 - RNA, 19 nt, Artificial Sequence
  Description of Artificial Sequence: Synthetic oligonucleotide
ucgguggcaccuucgaaau

SEQ ID NO: 7386 - RNA, 19 nt, Artificial Sequence
  Description of Artificial Sequence: Synthetic oligonucleotide
gucgguggcaccuucgaaa

SEQ ID NO: 7387 - RNA, 19 nt, Artificial Sequence
  Description of Artificial Sequence: Synthetic oligonucleotide
ugucgguggcaccuucgaa

SEQ ID NO: 7388 - RNA, 19 nt, Artificial Sequence
  Description of Artificial Sequence: Synthetic oligonucleotide
gugucgguggcaccuucga

SEQ ID NO: 7389 - RNA, 19 nt, Artificial Sequence
  Description of Artificial Sequence: Synthetic oligonucleotide
ugugucgguggcaccuucg

SEQ ID NO: 7390 - RNA, 19 nt, Artificial Sequence
  Description of Artificial Sequence: Synthetic oligonucleotide
augugucgguggcaccuuc

SEQ ID NO: 7391 - RNA, 19 nt, Artificial Sequence
  Description of Artificial Sequence: Synthetic oligonucleotide
caugugucgguggcaccuu

SEQ ID NO: 7392 - RNA, 19 nt, Artificial Sequence
  Description of Artificial Sequence: Synthetic oligonucleotide
gcaugugucgguggcaccu

SEQ ID NO: 7393 - RNA, 19 nt, Artificial Sequence
  Description of Artificial Sequence: Synthetic oligonucleotide
ugcaugugucgguggcacc

SEQ ID NO: 7394 - RNA, 19 nt, Artificial Sequence
  Description of Artificial Sequence: Synthetic oligonucleotide
uugcaugugucgguggcac

SEQ ID NO: 7395 - RNA, 19 nt, Artificial Sequence
  Description of Artificial Sequence: Synthetic oligonucleotide
guugcaugugucgguggca

SEQ ID NO: 7396 - RNA, 19 nt, Artificial Sequence
  Description of Artificial Sequence: Synthetic oligonucleotide
aguugcaugugucgguggc

SEQ ID NO: 7397 - RNA, 19 nt, Artificial Sequence
  Description of Artificial Sequence: Synthetic oligonucleotide
aaguugcaugugucggugg

SEQ ID NO: 7398 - RNA, 19 nt, Artificial Sequence
  Description of Artificial Sequence: Synthetic oligonucleotide
gaaguugcaugugucggug

SEQ ID NO: 7399 - RNA, 19 nt, Artificial Sequence
  Description of Artificial Sequence: Synthetic oligonucleotide
cgaaguugcaugugucggu

SEQ ID NO: 7400 - RNA, 19 nt, Artificial Sequence
  Description of Artificial Sequence: Synthetic oligonucleotide
ucgaaguugcaugugucgg

SEQ ID NO: 7401 - RNA, 19 nt, Artificial Sequence
  Description of Artificial Sequence: Synthetic oligonucleotide
gucgaaguugcaugugucg

SEQ ID NO: 7402 - RNA, 19 nt, Artificial Sequence
  Description of Artificial Sequence: Synthetic oligonucleotide
agucgaaguugcauguguc

SEQ ID NO: 7403 - RNA, 19 nt, Artificial Sequence
  Description of Artificial Sequence: Synthetic oligonucleotide
aagucgaaguugcaugugu

SEQ ID NO: 7404 - RNA, 19 nt, Artificial Sequence
  Description of Artificial Sequence: Synthetic oligonucleotide
caagucgaaguugcaugug

SEQ ID NO: 7405 - RNA, 19 nt, Artificial Sequence
  Description of Artificial Sequence: Synthetic oligonucleotide
ccaagucgaaguugcaugu

SEQ ID NO: 7406 - RNA, 19 nt, Artificial Sequence
  Description of Artificial Sequence: Synthetic oligonucleotide
accaagucgaaguugcaug

SEQ ID NO: 7407 - RNA, 19 nt, Artificial Sequence
  Description of Artificial Sequence: Synthetic oligonucleotide
caccaagucgaaguugcau

SEQ ID NO: 7408 - RNA, 19 nt, Artificial Sequence
  Description of Artificial Sequence: Synthetic oligonucleotide
ccaccaagucgaaguugca

SEQ ID NO: 7409 - RNA, 19 nt, Artificial Sequence
  Description of Artificial Sequence: Synthetic oligonucleotide
uccaccaagucgaaguugc

SEQ ID NO: 7410 - RNA, 19 nt, Artificial Sequence
  Description of Artificial Sequence: Synthetic oligonucleotide
cuccaccaagucgaaguug

SEQ ID NO: 7411 - RNA, 19 nt, Artificial Sequence
  Description of Artificial Sequence: Synthetic oligonucleotide
ccuccaccaagucgaaguu

SEQ ID NO: 7412 - RNA, 19 nt, Artificial Sequence
  Description of Artificial Sequence: Synthetic oligonucleotide
uccuccaccaagucgaagu

SEQ ID NO: 7413 - RNA, 19 nt, Artificial Sequence
  Description of Artificial Sequence: Synthetic oligonucleotide
guccuccaccaagucgaag

SEQ ID NO: 7414 - RNA, 19 nt, Artificial Sequence
  Description of Artificial Sequence: Synthetic oligonucleotide
cguccuccaccaagucgaa

SEQ ID NO: 7415 - RNA, 19 nt, Artificial Sequence
  Description of Artificial Sequence: Synthetic oligonucleotide
ccguccuccaccaagucga

SEQ ID NO: 7416 - RNA, 19 nt, Artificial Sequence
  Description of Artificial Sequence: Synthetic oligonucleotide
cccguccuccaccaagucg

SEQ ID NO: 7417 - RNA, 19 nt, Artificial Sequence
  Description of Artificial Sequence: Synthetic oligonucleotide
gcccguccuccaccaaguc

SEQ ID NO: 7418 - RNA, 19 nt, Artificial Sequence
  Description of Artificial Sequence: Synthetic oligonucleotide
agcccguccuccaccaagu

SEQ ID NO: 7419 - RNA, 19 nt, Artificial Sequence
  Description of Artificial Sequence: Synthetic oligonucleotide
gagcccguccuccaccaag

SEQ ID NO: 7420 - RNA, 19 nt, Artificial Sequence
  Description of Artificial Sequence: Synthetic oligonucleotide
ugagcccguccuccaccaa

SEQ ID NO: 7421 - RNA, 19 nt, Artificial Sequence
  Description of Artificial Sequence: Synthetic oligonucleotide
gugagcccguccuccacca

SEQ ID NO: 7422 - RNA, 19 nt, Artificial Sequence
  Description of Artificial Sequence: Synthetic oligonucleotide
agugagcccguccuccacc

SEQ ID NO: 7423 - RNA, 19 nt, Artificial Sequence
  Description of Artificial Sequence: Synthetic oligonucleotide
cagugagcccguccuccac

SEQ ID NO: 7424 - RNA, 19 nt, Artificial Sequence
  Description of Artificial Sequence: Synthetic oligonucleotide
gcagugagcccguccucca

SEQ ID NO: 7425 - RNA, 19 nt, Artificial Sequence
  Description of Artificial Sequence: Synthetic oligonucleotide
ggcagugagcccguccucc

SEQ ID NO: 7426 - RNA, 19 nt, Artificial Sequence
  Description of Artificial Sequence: Synthetic oligonucleotide
uggcagugagcccguccuc

SEQ ID NO: 7427 - RNA, 19 nt, Artificial Sequence
  Description of Artificial Sequence: Synthetic oligonucleotide
auggcagugagcccguccu

SEQ ID NO: 7428 - RNA, 19 nt, Artificial Sequence
  Description of Artificial Sequence: Synthetic oligonucleotide
cauggcagugagcccgucc

SEQ ID NO: 7429 - RNA, 19 nt, Artificial Sequence
  Description of Artificial Sequence: Synthetic oligonucleotide
ccauggcagugagcccguc

SEQ ID NO: 7430 - RNA, 19 nt, Artificial Sequence
  Description of Artificial Sequence: Synthetic oligonucleotide
uccauggcagugagcccgu

SEQ ID NO: 7431 - RNA, 19 nt, Artificial Sequence
  Description of Artificial Sequence: Synthetic oligonucleotide
cuccauggcagugagcccg

SEQ ID NO: 7432 - RNA, 19 nt, Artificial Sequence
  Description of Artificial Sequence: Synthetic oligonucleotide
ucuccauggcagugagccc

SEQ ID NO: 7433 - RNA, 19 nt, Artificial Sequence
  Description of Artificial Sequence: Synthetic oligonucleotide
gucuccauggcagugagcc

SEQ ID NO: 7434 - RNA, 19 nt, Artificial Sequence
  Description of Artificial Sequence: Synthetic oligonucleotide
ugucuccauggcagugagc

SEQ ID NO: 7435 - RNA, 19 nt, Artificial Sequence
  Description of Artificial Sequence: Synthetic oligonucleotide
gugucuccauggcagugag

SEQ ID NO: 7436 - RNA, 19 nt, Artificial Sequence
  Description of Artificial Sequence: Synthetic oligonucleotide
agugucuccauggcaguga

SEQ ID NO: 7437 - RNA, 19 nt, Artificial Sequence
  Description of Artificial Sequence: Synthetic oligonucleotide
cagugucuccauggcagug

SEQ ID NO: 7438 - RNA, 19 nt, Artificial Sequence
  Description of Artificial Sequence: Synthetic oligonucleotide
acagugucuccauggcagu

SEQ ID NO: 7439 - RNA, 19 nt, Artificial Sequence
  Description of Artificial Sequence: Synthetic oligonucleotide
gacagugucuccauggcag

SEQ ID NO: 7440 - RNA, 19 nt, Artificial Sequence
  Description of Artificial Sequence: Synthetic oligonucleotide
cgacagugucuccauggca

SEQ ID NO: 7441 - RNA, 19 nt, Artificial Sequence
  Description of Artificial Sequence: Synthetic oligonucleotide
ccgacagugucuccauggc

SEQ ID NO: 7442 - RNA, 19 nt, Artificial Sequence
  Description of Artificial Sequence: Synthetic oligonucleotide
uccgacagugucuccaugg

SEQ ID NO: 7443 - RNA, 19 nt, Artificial Sequence
  Description of Artificial Sequence: Synthetic oligonucleotide
guccgacagugucuccaug

SEQ ID NO: 7444 - RNA, 19 nt, Artificial Sequence
  Description of Artificial Sequence: Synthetic oligonucleotide
uguccgacagugucuccau

SEQ ID NO: 7445 - RNA, 19 nt, Artificial Sequence
  Description of Artificial Sequence: Synthetic oligonucleotide
auguccgacagugucucca

SEQ ID NO: 7446 - RNA, 19 nt, Artificial Sequence
  Description of Artificial Sequence: Synthetic oligonucleotide
aauguccgacagugucucc

SEQ ID NO: 7447 - RNA, 19 nt, Artificial Sequence
  Description of Artificial Sequence: Synthetic oligonucleotide
gaauguccgacagugucuc

SEQ ID NO: 7448 - RNA, 19 nt, Artificial Sequence
  Description of Artificial Sequence: Synthetic oligonucleotide
cgaauguccgacagugucu

SEQ ID NO: 7449 - RNA, 19 nt, Artificial Sequence
  Description of Artificial Sequence: Synthetic oligonucleotide
ccgaauguccgacaguguc

SEQ ID NO: 7450 - RNA, 19 nt, Artificial Sequence
  Description of Artificial Sequence: Synthetic oligonucleotide
cccgaauguccgacagugu

SEQ ID NO: 7451 - RNA, 19 nt, Artificial Sequence
  Description of Artificial Sequence: Synthetic oligonucleotide
ucccgaauguccgacagug

SEQ ID NO: 7452 - RNA, 19 nt, Artificial Sequence
  Description of Artificial Sequence: Synthetic oligonucleotide
uucccgaauguccgacagu

SEQ ID NO: 7453 - RNA, 19 nt, Artificial Sequence
  Description of Artificial Sequence: Synthetic oligonucleotide
cuucccgaauguccgacag

SEQ ID NO: 7454 - RNA, 19 nt, Artificial Sequence
  Description of Artificial Sequence: Synthetic oligonucleotide
ccuucccgaauguccgaca

SEQ ID NO: 7455 - RNA, 19 nt, Artificial Sequence
  Description of Artificial Sequence: Synthetic oligonucleotide
accuucccgaauguccgac

SEQ ID NO: 7456 - RNA, 19 nt, Artificial Sequence
  Description of Artificial Sequence: Synthetic oligonucleotide
caccuucccgaauguccga

SEQ ID NO: 7457 - RNA, 19 nt, Artificial Sequence
  Description of Artificial Sequence: Synthetic oligonucleotide
gcaccuucccgaauguccg

SEQ ID NO: 7458 - RNA, 19 nt, Artificial Sequence
  Description of Artificial Sequence: Synthetic oligonucleotide
cgcaccuucccgaaugucc

SEQ ID NO: 7459 - RNA, 19 nt, Artificial Sequence
  Description of Artificial Sequence: Synthetic oligonucleotide
gcgcaccuucccgaauguc

SEQ ID NO: 7460 - RNA, 19 nt, Artificial Sequence
  Description of Artificial Sequence: Synthetic oligonucleotide
ggcgcaccuucccgaaugu

SEQ ID NO: 7461 - RNA, 19 nt, Artificial Sequence
  Description of Artificial Sequence: Synthetic oligonucleotide
cggcgcaccuucccgaaug

SEQ ID NO: 7462 - RNA, 19 nt, Artificial Sequence
  Description of Artificial Sequence: Synthetic oligonucleotide
gcggcgcaccuucccgaau

SEQ ID NO: 7463 - RNA, 19 nt, Artificial Sequence
  Description of Artificial Sequence: Synthetic oligonucleotide
agcggcgcaccuucccgaa

SEQ ID NO: 7464 - RNA, 19 nt, Artificial Sequence
  Description of Artificial Sequence: Synthetic oligonucleotide
uagcggcgcaccuucccga

SEQ ID NO: 7465 - RNA, 19 nt, Artificial Sequence
  Description of Artificial Sequence: Synthetic oligonucleotide
cuagcggcgcaccuucccg

SEQ ID NO: 7466 - RNA, 19 nt, Artificial Sequence
  Description of Artificial Sequence: Synthetic oligonucleotide
ccuagcggcgcaccuuccc

SEQ ID NO: 7467 - RNA, 19 nt, Artificial Sequence
  Description of Artificial Sequence: Synthetic oligonucleotide
cccuagcggcgcaccuucc

SEQ ID NO: 7468 - RNA, 19 nt, Artificial Sequence
  Description of Artificial Sequence: Synthetic oligonucleotide
ccccuagcggcgcaccuuc

SEQ ID NO: 7469 - RNA, 19 nt, Artificial Sequence
  Description of Artificial Sequence: Synthetic oligonucleotide
accccuagcggcgcaccuu

SEQ ID NO: 7470 - RNA, 19 nt, Artificial Sequence
  Description of Artificial Sequence: Synthetic oligonucleotide
gaccccuagcggcgcaccu

SEQ ID NO: 7471 - RNA, 19 nt, Artificial Sequence
  Description of Artificial Sequence: Synthetic oligonucleotide
ggaccccuagcggcgcacc

SEQ ID NO: 7472 - RNA, 19 nt, Artificial Sequence
  Description of Artificial Sequence: Synthetic oligonucleotide
uggaccccuagcggcgcac

SEQ ID NO: 7473 - RNA, 19 nt, Artificial Sequence
  Description of Artificial Sequence: Synthetic oligonucleotide
guggaccccuagcggcgca

SEQ ID NO: 7474 - RNA, 19 nt, Artificial Sequence
  Description of Artificial Sequence: Synthetic oligonucleotide
gguggaccccuagcggcgc

SEQ ID NO: 7475 - RNA, 19 nt, Artificial Sequence
  Description of Artificial Sequence: Synthetic oligonucleotide
agguggaccccuagcggcg

SEQ ID NO: 7476 - RNA, 19 nt, Artificial Sequence
  Description of Artificial Sequence: Synthetic oligonucleotide
cagguggaccccuagcggc

SEQ ID NO: 7477 - RNA, 19 nt, Artificial Sequence
  Description of Artificial Sequence: Synthetic oligonucleotide
gcagguggaccccuagcgg

SEQ ID NO: 7478 - RNA, 19 nt, Artificial Sequence
  Description of Artificial Sequence: Synthetic oligonucleotide
ggcagguggaccccuagcg

SEQ ID NO: 7479 - RNA, 19 nt, Artificial Sequence
  Description of Artificial Sequence: Synthetic oligonucleotide
aggcagguggaccccuagc

SEQ ID NO: 7480 - RNA, 19 nt, Artificial Sequence
  Description of Artificial Sequence: Synthetic oligonucleotide
aaggcagguggaccccuag

SEQ ID NO: 7481 - RNA, 19 nt, Artificial Sequence
  Description of Artificial Sequence: Synthetic oligonucleotide
aaaggcagguggaccccua

SEQ ID NO: 7482 - RNA, 19 nt, Artificial Sequence
  Description of Artificial Sequence: Synthetic oligonucleotide
aaaaggcagguggaccccu

SEQ ID NO: 7483 - RNA, 19 nt, Artificial Sequence
  Description of Artificial Sequence: Synthetic oligonucleotide
caaaaggcagguggacccc

SEQ ID NO: 7484 - RNA, 19 nt, Artificial Sequence
  Description of Artificial Sequence: Synthetic oligonucleotide
acaaaaggcagguggaccc

SEQ ID NO: 7485 - RNA, 19 nt, Artificial Sequence
  Description of Artificial Sequence: Synthetic oligonucleotide
cacaaaaggcagguggacc

SEQ ID NO: 7486 - RNA, 19 nt, Artificial Sequence
  Description of Artificial Sequence: Synthetic oligonucleotide
ccacaaaaggcagguggac

SEQ ID NO: 7487 - RNA, 19 nt, Artificial Sequence
  Description of Artificial Sequence: Synthetic oligonucleotide
cccacaaaaggcaggugga

SEQ ID NO: 7488 - RNA, 19 nt, Artificial Sequence
  Description of Artificial Sequence: Synthetic oligonucleotide
gcccacaaaaggcaggugg

SEQ ID NO: 7489 - RNA, 19 nt, Artificial Sequence
  Description of Artificial Sequence: Synthetic oligonucleotide
agcccacaaaaggcaggug

SEQ ID NO: 7490 - RNA, 19 nt, Artificial Sequence
  Description of Artificial Sequence: Synthetic oligonucleotide
uagcccacaaaaggcaggu

SEQ ID NO: 7491 - RNA, 19 nt, Artificial Sequence
  Description of Artificial Sequence: Synthetic oligonucleotide
guagcccacaaaaggcagg

SEQ ID NO: 7492 - RNA, 19 nt, Artificial Sequence
  Description of Artificial Sequence: Synthetic oligonucleotide
aguagcccacaaaaggcag

SEQ ID NO: 7493 - RNA, 19 nt, Artificial Sequence
  Description of Artificial Sequence: Synthetic oligonucleotide
gaguagcccacaaaaggca

SEQ ID NO: 7494 - RNA, 19 nt, Artificial Sequence
  Description of Artificial Sequence: Synthetic oligonucleotide
ggaguagcccacaaaaggc

SEQ ID NO: 7495 - RNA, 19 nt, Artificial Sequence
  Description of Artificial Sequence: Synthetic oligonucleotide
aggaguagcccacaaaagg

SEQ ID NO: 7496 - RNA, 19 nt, Artificial Sequence
  Description of Artificial Sequence: Synthetic oligonucleotide
uaggaguagcccacaaaag

SEQ ID NO: 7497 - RNA, 19 nt, Artificial Sequence
  Description of Artificial Sequence: Synthetic oligonucleotide
guaggaguagcccacaaaa

SEQ ID NO: 7498 - RNA, 19 nt, Artificial Sequence
  Description of Artificial Sequence: Synthetic oligonucleotide
aguaggaguagcccacaaa

SEQ ID NO: 7499 - RNA, 19 nt, Artificial Sequence
  Description of Artificial Sequence: Synthetic oligonucleotide
gaguaggaguagcccacaa

SEQ ID NO: 7500 - RNA, 19 nt, Artificial Sequence
  Description of Artificial Sequence: Synthetic oligonucleotide
ggaguaggaguagcccaca

SEQ ID NO: 7501 - RNA, 19 nt, Artificial Sequence
  Description of Artificial Sequence: Synthetic oligonucleotide
aggaguaggaguagcccac

SEQ ID NO: 7502 - RNA, 19 nt, Artificial Sequence
  Description of Artificial Sequence: Synthetic oligonucleotide
caggaguaggaguagccca

SEQ ID NO: 7503 - RNA, 19 nt, Artificial Sequence
  Description of Artificial Sequence: Synthetic oligonucleotide
gcaggaguaggaguagccc

SEQ ID NO: 7504 - RNA, 19 nt, Artificial Sequence
  Description of Artificial Sequence: Synthetic oligonucleotide
ugcaggaguaggaguagcc

SEQ ID NO: 7505 - RNA, 19 nt, Artificial Sequence
  Description of Artificial Sequence: Synthetic oligonucleotide
augcaggaguaggaguagc

SEQ ID NO: 7506 - RNA, 19 nt, Artificial Sequence
  Description of Artificial Sequence: Synthetic oligonucleotide
caugcaggaguaggaguag

SEQ ID NO: 7507 - RNA, 19 nt, Artificial Sequence
  Description of Artificial Sequence: Synthetic oligonucleotide
ccaugcaggaguaggagua

SEQ ID NO: 7508 - RNA, 19 nt, Artificial Sequence
  Description of Artificial Sequence: Synthetic oligonucleotide
gccaugcaggaguaggagu

SEQ ID NO: 7509 - RNA, 19 nt, Artificial Sequence
  Description of Artificial Sequence: Synthetic oligonucleotide
ggccaugcaggaguaggag

SEQ ID NO: 7510 - RNA, 19 nt, Artificial Sequence
  Description of Artificial Sequence: Synthetic oligonucleotide
gggccaugcaggaguagga

SEQ ID NO: 7511 - RNA, 19 nt, Artificial Sequence
  Description of Artificial Sequence: Synthetic oligonucleotide
agggccaugcaggaguagg

SEQ ID NO: 7512 - RNA, 19 nt, Artificial Sequence
  Description of Artificial Sequence: Synthetic oligonucleotide
gagggccaugcaggaguag

SEQ ID NO: 7513 - RNA, 19 nt, Artificial Sequence
  Description of Artificial Sequence: Synthetic oligonucleotide
ugagggccaugcaggagua

SEQ ID NO: 7514 - RNA, 19 nt, Artificial Sequence
  Description of Artificial Sequence: Synthetic oligonucleotide
cugagggccaugcaggagu

SEQ ID NO: 7515 - RNA, 19 nt, Artificial Sequence
  Description of Artificial Sequence: Synthetic oligonucleotide
ccugagggccaugcaggag

SEQ ID NO: 7516 - RNA, 19 nt, Artificial Sequence
  Description of Artificial Sequence: Synthetic oligonucleotide
cccugagggccaugcagga

SEQ ID NO: 7517 - RNA, 19 nt, Artificial Sequence
  Description of Artificial Sequence: Synthetic oligonucleotide
ucccugagggccaugcagg

SEQ ID NO: 7518 - RNA, 19 nt, Artificial Sequence
  Description of Artificial Sequence: Synthetic oligonucleotide
gucccugagggccaugcag

SEQ ID NO: 7519 - RNA, 19 nt, Artificial Sequence
  Description of Artificial Sequence: Synthetic oligonucleotide
ugucccugagggccaugca

SEQ ID NO: 7520 - RNA, 19 nt, Artificial Sequence
  Description of Artificial Sequence: Synthetic oligonucleotide
cugucccugagggccaugc

SEQ ID NO: 7521 - RNA, 19 nt, Artificial Sequence
  Description of Artificial Sequence: Synthetic oligonucleotide
acugucccugagggccaug

SEQ ID NO: 7522 - RNA, 19 nt, Artificial Sequence
  Description of Artificial Sequence: Synthetic oligonucleotide
cacugucccugagggccau

SEQ ID NO: 7523 - RNA, 19 nt, Artificial Sequence
  Description of Artificial Sequence: Synthetic oligonucleotide
ucacugucccugagggcca

SEQ ID NO: 7524 - RNA, 19 nt, Artificial Sequence
  Description of Artificial Sequence: Synthetic oligonucleotide
cucacugucccugagggcc

SEQ ID NO: 7525 - RNA, 19 nt, Artificial Sequence
  Description of Artificial Sequence: Synthetic oligonucleotide
ccucacugucccugagggc

SEQ ID NO: 7526 - RNA, 19 nt, Artificial Sequence
  Description of Artificial Sequence: Synthetic oligonucleotide
accucacugucccugaggg

SEQ ID NO: 7527 - RNA, 19 nt, Artificial Sequence
  Description of Artificial Sequence: Synthetic oligonucleotide
gaccucacugucccugagg

SEQ ID NO: 7528 - RNA, 19 nt, Artificial Sequence
  Description of Artificial Sequence: Synthetic oligonucleotide
ggaccucacugucccugag

SEQ ID NO: 7529 - RNA, 19 nt, Artificial Sequence
  Description of Artificial Sequence: Synthetic oligonucleotide
gggaccucacugucccuga

SEQ ID NO: 7530 - RNA, 19 nt, Artificial Sequence
  Description of Artificial Sequence: Synthetic oligonucleotide
ugggaccucacugucccug

SEQ ID NO: 7531 - RNA, 19 nt, Artificial Sequence
  Description of Artificial Sequence: Synthetic oligonucleotide
cugggaccucacugucccu

SEQ ID NO: 7532 - RNA, 19 nt, Artificial Sequence
  Description of Artificial Sequence: Synthetic oligonucleotide
ccugggaccucacuguccc

SEQ ID NO: 7533 - RNA, 19 nt, Artificial Sequence
  Description of Artificial Sequence: Synthetic oligonucleotide
gccugggaccucacugucc

SEQ ID NO: 7534 - RNA, 19 nt, Artificial Sequence
  Description of Artificial Sequence: Synthetic oligonucleotide
ggccugggaccucacuguc

SEQ ID NO: 7535 - RNA, 19 nt, Artificial Sequence
  Description of Artificial Sequence: Synthetic oligonucleotide
gggccugggaccucacugu

SEQ ID NO: 7536 - RNA, 19 nt, Artificial Sequence
  Description of Artificial Sequence: Synthetic oligonucleotide
ggggccugggaccucacug

SEQ ID NO: 7537 - RNA, 19 nt, Artificial Sequence
  Description of Artificial Sequence: Synthetic oligonucleotide
uggggccugggaccucacu

SEQ ID NO: 7538 - RNA, 19 nt, Artificial Sequence
  Description of Artificial Sequence: Synthetic oligonucleotide
guggggccugggaccucac

SEQ ID NO: 7539 - RNA, 19 nt, Artificial Sequence
  Description of Artificial Sequence: Synthetic oligonucleotide
uguggggccugggaccuca

SEQ ID NO: 7540 - RNA, 19 nt, Artificial Sequence
  Description of Artificial Sequence: Synthetic oligonucleotide
guguggggccugggaccuc

SEQ ID NO: 7541 - RNA, 19 nt, Artificial Sequence
  Description of Artificial Sequence: Synthetic oligonucleotide
gguguggggccugggaccu

SEQ ID NO: 7542 - RNA, 19 nt, Artificial Sequence
  Description of Artificial Sequence: Synthetic oligonucleotide
ggguguggggccugggacc

SEQ ID NO: 7543 - RNA, 19 nt, Artificial Sequence
  Description of Artificial Sequence: Synthetic oligonucleotide
uggguguggggccugggac

SEQ ID NO: 7544 - RNA, 19 nt, Artificial Sequence
  Description of Artificial Sequence: Synthetic oligonucleotide
auggguguggggccuggga

SEQ ID NO: 7545 - RNA, 19 nt, Artificial Sequence
  Description of Artificial Sequence: Synthetic oligonucleotide
cauggguguggggccuggg

SEQ ID NO: 7546 - RNA, 19 nt, Artificial Sequence
  Description of Artificial Sequence: Synthetic oligonucleotide
ccauggguguggggccugg

SEQ ID NO: 7547 - RNA, 19 nt, Artificial Sequence
  Description of Artificial Sequence: Synthetic oligonucleotide
uccauggguguggggccug

SEQ ID NO: 7548 - RNA, 19 nt, Artificial Sequence
  Description of Artificial Sequence: Synthetic oligonucleotide
uuccauggguguggggccu

SEQ ID NO: 7549 - RNA, 19 nt, Artificial Sequence
  Description of Artificial Sequence: Synthetic oligonucleotide
guuccauggguguggggcc

SEQ ID NO: 7550 - RNA, 19 nt, Artificial Sequence
  Description of Artificial Sequence: Synthetic oligonucleotide
aguuccauggguguggggc

SEQ ID NO: 7551 - RNA, 19 nt, Artificial Sequence
  Description of Artificial Sequence: Synthetic oligonucleotide
caguuccaugggugugggg

SEQ ID NO: 7552 - RNA, 19 nt, Artificial Sequence
  Description of Artificial Sequence: Synthetic oligonucleotide
ccaguuccauggguguggg

SEQ ID NO: 7553 - RNA, 19 nt, Artificial Sequence
  Description of Artificial Sequence: Synthetic oligonucleotide
uccaguuccaugggugugg

SEQ ID NO: 7554 - RNA, 19 nt, Artificial Sequence
  Description of Artificial Sequence: Synthetic oligonucleotide
cuccaguuccaugggugug

SEQ ID NO: 7555 - RNA, 19 nt, Artificial Sequence
  Description of Artificial Sequence: Synthetic oligonucleotide
ccuccaguuccaugggugu

SEQ ID NO: 7556 - RNA, 19 nt, Artificial Sequence
  Description of Artificial Sequence: Synthetic oligonucleotide
gccuccaguuccaugggug

SEQ ID NO: 7557 - RNA, 19 nt, Artificial Sequence
  Description of Artificial Sequence: Synthetic oligonucleotide
ggccuccaguuccaugggu

SEQ ID NO: 7558 - RNA, 19 nt, Artificial Sequence
  Description of Artificial Sequence: Synthetic oligonucleotide
cggccuccaguuccauggg

SEQ ID NO: 7559 - RNA, 19 nt, Artificial Sequence
  Description of Artificial Sequence: Synthetic oligonucleotide
ucggccuccaguuccaugg

SEQ ID NO: 7560 - RNA, 19 nt, Artificial Sequence
  Description of Artificial Sequence: Synthetic oligonucleotide
cucggccuccaguuccaug

SEQ ID NO: 7561 - RNA, 19 nt, Artificial Sequence
  Description of Artificial Sequence: Synthetic oligonucleotide
gcucggccuccaguuccau

SEQ ID NO: 7562 - RNA, 19 nt, Artificial Sequence
  Description of Artificial Sequence: Synthetic oligonucleotide
ugcucggccuccaguucca

SEQ ID NO: 7563 - RNA, 19 nt, Artificial Sequence
  Description of Artificial Sequence: Synthetic oligonucleotide
cugcucggccuccaguucc

SEQ ID NO: 7564 - RNA, 19 nt, Artificial Sequence
  Description of Artificial Sequence: Synthetic oligonucleotide
gcugcucggccuccaguuc

SEQ ID NO: 7565 - RNA, 19 nt, Artificial Sequence
  Description of Artificial Sequence: Synthetic oligonucleotide
agcugcucggccuccaguu

SEQ ID NO: 7566 - RNA, 19 nt, Artificial Sequence
  Description of Artificial Sequence: Synthetic oligonucleotide
cagcugcucggccuccagu

SEQ ID NO: 7567 - RNA, 19 nt, Artificial Sequence
  Description of Artificial Sequence: Synthetic oligonucleotide
gcagcugcucggccuccag

SEQ ID NO: 7568 - RNA, 19 nt, Artificial Sequence
  Description of Artificial Sequence: Synthetic oligonucleotide
agcagcugcucggccucca

SEQ ID NO: 7569 - RNA, 19 nt, Artificial Sequence
  Description of Artificial Sequence: Synthetic oligonucleotide
aagcagcugcucggccucc

SEQ ID NO: 7570 - RNA, 19 nt, Artificial Sequence
  Description of Artificial Sequence: Synthetic oligonucleotide
caagcagcugcucggccuc

SEQ ID NO: 7571 - RNA, 19 nt, Artificial Sequence
  Description of Artificial Sequence: Synthetic oligonucleotide
ucaagcagcugcucggccu

SEQ ID NO: 7572 - RNA, 19 nt, Artificial Sequence
  Description of Artificial Sequence: Synthetic oligonucleotide
cucaagcagcugcucggcc

SEQ ID NO: 7573 - RNA, 19 nt, Artificial Sequence
  Description of Artificial Sequence: Synthetic oligonucleotide
gcucaagcagcugcucggc

SEQ ID NO: 7574 - RNA, 19 nt, Artificial Sequence
  Description of Artificial Sequence: Synthetic oligonucleotide
ggcucaagcagcugcucgg

SEQ ID NO: 7575 - RNA, 19 nt, Artificial Sequence
  Description of Artificial Sequence: Synthetic oligonucleotide
uggcucaagcagcugcucg

SEQ ID NO: 7576 - RNA, 19 nt, Artificial Sequence
  Description of Artificial Sequence: Synthetic oligonucleotide
guggcucaagcagcugcuc

SEQ ID NO: 7577 - RNA, 19 nt, Artificial Sequence
  Description of Artificial Sequence: Synthetic oligonucleotide
uguggcucaagcagcugcu

SEQ ID NO: 7578 - RNA, 19 nt, Artificial Sequence
  Description of Artificial Sequence: Synthetic oligonucleotide
guguggcucaagcagcugc

SEQ ID NO: 7579 - RNA, 19 nt, Artificial Sequence
  Description of Artificial Sequence: Synthetic oligonucleotide
cguguggcucaagcagcug

SEQ ID NO: 7580 - RNA, 19 nt, Artificial Sequence
  Description of Artificial Sequence: Synthetic oligonucleotide
acguguggcucaagcagcu

SEQ ID NO: 7581 - RNA, 19 nt, Artificial Sequence
  Description of Artificial Sequence: Synthetic oligonucleotide
cacguguggcucaagcagc

SEQ ID NO: 7582 - RNA, 19 nt, Artificial Sequence
  Description of Artificial Sequence: Synthetic oligonucleotide
gcacguguggcucaagcag

SEQ ID NO: 7583 - RNA, 19 nt, Artificial Sequence
  Description of Artificial Sequence: Synthetic oligonucleotide
ugcacguguggcucaagca

SEQ ID NO: 7584 - RNA, 19 nt, Artificial Sequence
  Description of Artificial Sequence: Synthetic oligonucleotide
uugcacguguggcucaagc

SEQ ID NO: 7585 - RNA, 19 nt, Artificial Sequence
  Description of Artificial Sequence: Synthetic oligonucleotide
cuugcacguguggcucaag

SEQ ID NO: 7586 - RNA, 19 nt, Artificial Sequence
  Description of Artificial Sequence: Synthetic oligonucleotide
gcuugcacguguggcucaa

SEQ ID NO: 7587 - RNA, 19 nt, Artificial Sequence
  Description of Artificial Sequence: Synthetic oligonucleotide
cgcuugcacguguggcuca

SEQ ID NO: 7588 - RNA, 19 nt, Artificial Sequence
  Description of Artificial Sequence: Synthetic oligonucleotide
gcgcuugcacguguggcuc

SEQ ID NO: 7589 - RNA, 19 nt, Artificial Sequence
  Description of Artificial Sequence: Synthetic oligonucleotide
ggcgcuugcacguguggcu

SEQ ID NO: 7590 - RNA, 19 nt, Artificial Sequence
  Description of Artificial Sequence: Synthetic oligonucleotide
gggcgcuugcacguguggc

SEQ ID NO: 7591 - RNA, 19 nt, Artificial Sequence
  Description of Artificial Sequence: Synthetic oligonucleotide
ugggcgcuugcacgugugg

SEQ ID NO: 7592 - RNA, 19 nt, Artificial Sequence
  Description of Artificial Sequence: Synthetic oligonucleotide
cugggcgcuugcacgugug

SEQ ID NO: 7593 - RNA, 19 nt, Artificial Sequence
  Description of Artificial Sequence: Synthetic oligonucleotide
gcugggcgcuugcacgugu

SEQ ID NO: 7594 - RNA, 19 nt, Artificial Sequence
  Description of Artificial Sequence: Synthetic oligonucleotide
ggcugggcgcuugcacgug

SEQ ID NO: 7595 - RNA, 19 nt, Artificial Sequence
  Description of Artificial Sequence: Synthetic oligonucleotide
aggcugggcgcuugcacgu

SEQ ID NO: 7596 - RNA, 19 nt, Artificial Sequence
  Description of Artificial Sequence: Synthetic oligonucleotide
caggcugggcgcuugcacg

SEQ ID NO: 7597 - RNA, 19 nt, Artificial Sequence
  Description of Artificial Sequence: Synthetic oligonucleotide
ccaggcugggcgcuugcac

SEQ ID NO: 7598 - RNA, 19 nt, Artificial Sequence
  Description of Artificial Sequence: Synthetic oligonucleotide
uccaggcugggcgcuugca

SEQ ID NO: 7599 - RNA, 19 nt, Artificial Sequence
  Description of Artificial Sequence: Synthetic oligonucleotide
cuccaggcugggcgcuugc

SEQ ID NO: 7600 - RNA, 19 nt, Artificial Sequence
  Description of Artificial Sequence: Synthetic oligonucleotide
gcuccaggcugggcgcuug

SEQ ID NO: 7601 - RNA, 19 nt, Artificial Sequence
  Description of Artificial Sequence: Synthetic oligonucleotide
ggcuccaggcugggcgcuu

SEQ ID NO: 7602 - RNA, 19 nt, Artificial Sequence
  Description of Artificial Sequence: Synthetic oligonucleotide
gggcuccaggcugggcgcu

SEQ ID NO: 7603 - RNA, 19 nt, Artificial Sequence
  Description of Artificial Sequence: Synthetic oligonucleotide
agggcuccaggcugggcgc

SEQ ID NO: 7604 - RNA, 19 nt, Artificial Sequence
  Description of Artificial Sequence: Synthetic oligonucleotide
gagggcuccaggcugggcg

SEQ ID NO: 7605 - RNA, 19 nt, Artificial Sequence
  Description of Artificial Sequence: Synthetic oligonucleotide
cgagggcuccaggcugggc

SEQ ID NO: 7606 - RNA, 19 nt, Artificial Sequence
  Description of Artificial Sequence: Synthetic oligonucleotide
ccgagggcuccaggcuggg

SEQ ID NO: 7607 - RNA, 19 nt, Artificial Sequence
  Description of Artificial Sequence: Synthetic oligonucleotide
accgagggcuccaggcugg

SEQ ID NO: 7608 - RNA, 19 nt, Artificial Sequence
  Description of Artificial Sequence: Synthetic oligonucleotide
caccgagggcuccaggcug

SEQ ID NO: 7609 - RNA, 19 nt, Artificial Sequence
  Description of Artificial Sequence: Synthetic oligonucleotide
acaccgagggcuccaggcu

SEQ ID NO: 7610 - RNA, 19 nt, Artificial Sequence
  Description of Artificial Sequence: Synthetic oligonucleotide
gacaccgagggcuccaggc

SEQ ID NO: 7611 - RNA, 19 nt, Artificial Sequence
  Description of Artificial Sequence: Synthetic oligonucleotide
ggacaccgagggcuccagg

SEQ ID NO: 7612 - RNA, 19 nt, Artificial Sequence
  Description of Artificial Sequence: Synthetic oligonucleotide
gggacaccgagggcuccag

SEQ ID NO: 7613 - RNA, 19 nt, Artificial Sequence
  Description of Artificial Sequence: Synthetic oligonucleotide
ggggacaccgagggcucca

SEQ ID NO: 7614 - RNA, 19 nt, Artificial Sequence
  Description of Artificial Sequence: Synthetic oligonucleotide
uggggacaccgagggcucc

SEQ ID NO: 7615 - RNA, 19 nt, Artificial Sequence
  Description of Artificial Sequence: Synthetic oligonucleotide
guggggacaccgagggcuc

SEQ ID NO: 7616 - RNA, 19 nt, Artificial Sequence
  Description of Artificial Sequence: Synthetic oligonucleotide
uguggggacaccgagggcu

SEQ ID NO: 7617 - RNA, 19 nt, Artificial Sequence
  Description of Artificial Sequence: Synthetic oligonucleotide
cuguggggacaccgagggc

SEQ ID NO: 7618 - RNA, 19 nt, Artificial Sequence
  Description of Artificial Sequence: Synthetic oligonucleotide
ccuguggggacaccgaggg

SEQ ID NO: 7619 - RNA, 19 nt, Artificial Sequence
  Description of Artificial Sequence: Synthetic oligonucleotide
uccuguggggacaccgagg

SEQ ID NO: 7620 - RNA, 19 nt, Artificial Sequence
  Description of Artificial Sequence: Synthetic oligonucleotide
auccuguggggacaccgag

SEQ ID NO: 7621 - RNA, 19 nt, Artificial Sequence
  Description of Artificial Sequence: Synthetic oligonucleotide
cauccuguggggacaccga

SEQ ID NO: 7622 - RNA, 19 nt, Artificial Sequence
  Description of Artificial Sequence: Synthetic oligonucleotide
ucauccuguggggacaccg

SEQ ID NO: 7623 - RNA, 19 nt, Artificial Sequence
  Description of Artificial Sequence: Synthetic oligonucleotide
uucauccuguggggacacc

SEQ ID NO: 7624 - RNA, 19 nt, Artificial Sequence
  Description of Artificial Sequence: Synthetic oligonucleotide
uuucauccuguggggacac

SEQ ID NO: 7625 - RNA, 19 nt, Artificial Sequence
  Description of Artificial Sequence: Synthetic oligonucleotide
guuucauccuguggggaca

SEQ ID NO: 7626 - RNA, 19 nt, Artificial Sequence
  Description of Artificial Sequence: Synthetic oligonucleotide
uguuucauccuguggggac

SEQ ID NO: 7627 - RNA, 19 nt, Artificial Sequence
  Description of Artificial Sequence: Synthetic oligonucleotide
cuguuucauccugugggga

SEQ ID NO: 7628 - RNA, 19 nt, Artificial Sequence
  Description of Artificial Sequence: Synthetic oligonucleotide
gcuguuucauccugugggg

SEQ ID NO: 7629 - RNA, 19 nt, Artificial Sequence
  Description of Artificial Sequence: Synthetic oligonucleotide
agcuguuucauccuguggg

SEQ ID NO: 7630 - RNA, 19 nt, Artificial Sequence
  Description of Artificial Sequence: Synthetic oligonucleotide
cagcuguuucauccugugg

SEQ ID NO: 7631 - RNA, 19 nt, Artificial Sequence
  Description of Artificial Sequence: Synthetic oligonucleotide
ucagcuguuucauccugug

SEQ ID NO: 7632 - RNA, 19 nt, Artificial Sequence
  Description of Artificial Sequence: Synthetic oligonucleotide
uucagcuguuucauccugu

SEQ ID NO: 7633 - RNA, 19 nt, Artificial Sequence
  Description of Artificial Sequence: Synthetic oligonucleotide
cuucagcuguuucauccug

SEQ ID NO: 7634 - RNA, 19 nt, Artificial Sequence
  Description of Artificial Sequence: Synthetic oligonucleotide
acuucagcuguuucauccu

SEQ ID NO: 7635 - RNA, 19 nt, Artificial Sequence
  Description of Artificial Sequence: Synthetic oligonucleotide
cacuucagcuguuucaucc

SEQ ID NO: 7636 - RNA, 19 nt, Artificial Sequence
  Description of Artificial Sequence: Synthetic oligonucleotide
ccacuucagcuguuucauc

SEQ ID NO: 7637 - RNA, 19 nt, Artificial Sequence
  Description of Artificial Sequence: Synthetic oligonucleotide
gccacuucagcuguuucau

SEQ ID NO: 7638 - RNA, 19 nt, Artificial Sequence
  Description of Artificial Sequence: Synthetic oligonucleotide
ugccacuucagcuguuuca

SEQ ID NO: 7639 - RNA, 19 nt, Artificial Sequence
  Description of Artificial Sequence: Synthetic oligonucleotide
cugccacuucagcuguuuc

SEQ ID NO: 7640 - RNA, 19 nt, Artificial Sequence
  Description of Artificial Sequence: Synthetic oligonucleotide
acugccacuucagcuguuu

SEQ ID NO: 7641 - RNA, 19 nt, Artificial Sequence
  Description of Artificial Sequence: Synthetic oligonucleotide
aacugccacuucagcuguu

SEQ ID NO: 7642 - RNA, 19 nt, Artificial Sequence
  Description of Artificial Sequence: Synthetic oligonucleotide
gaacugccacuucagcugu

SEQ ID NO: 7643 - RNA, 19 nt, Artificial Sequence
  Description of Artificial Sequence: Synthetic oligonucleotide
ggaacugccacuucagcug

SEQ ID NO: 7644 - RNA, 19 nt, Artificial Sequence
  Description of Artificial Sequence: Synthetic oligonucleotide
uggaacugccacuucagcu

SEQ ID NO: 7645 - RNA, 19 nt, Artificial Sequence
  Description of Artificial Sequence: Synthetic oligonucleotide
cuggaacugccacuucagc

SEQ ID NO: 7646 - RNA, 19 nt, Artificial Sequence
  Description of Artificial Sequence: Synthetic oligonucleotide
gcuggaacugccacuucag

SEQ ID NO: 7647 - RNA, 19 nt, Artificial Sequence
  Description of Artificial Sequence: Synthetic oligonucleotide
cgcuggaacugccacuuca

SEQ ID NO: 7648 - RNA, 19 nt, Artificial Sequence
  Description of Artificial Sequence: Synthetic oligonucleotide
ccgcuggaacugccacuuc

SEQ ID NO: 7649 - RNA, 19 nt, Artificial Sequence
  Description of Artificial Sequence: Synthetic oligonucleotide
gccgcuggaacugccacuu

SEQ ID NO: 7650 - RNA, 19 nt, Artificial Sequence
  Description of Artificial Sequence: Synthetic oligonucleotide
agccgcuggaacugccacu

SEQ ID NO: 7651 - RNA, 19 nt, Artificial Sequence
  Description of Artificial Sequence: Synthetic oligonucleotide
cagccgcuggaacugccac

SEQ ID NO: 7652 - RNA, 19 nt, Artificial Sequence
  Description of Artificial Sequence: Synthetic oligonucleotide
acagccgcuggaacugcca

SEQ ID NO: 7653 - RNA, 19 nt, Artificial Sequence
  Description of Artificial Sequence: Synthetic oligonucleotide
gacagccgcuggaacugcc

SEQ ID NO: 7654 - RNA, 19 nt, Artificial Sequence
  Description of Artificial Sequence: Synthetic oligonucleotide
ggacagccgcuggaacugc

SEQ ID NO: 7655 - RNA, 19 nt, Artificial Sequence
  Description of Artificial Sequence: Synthetic oligonucleotide
gggacagccgcuggaacug

SEQ ID NO: 7656 - RNA, 19 nt, Artificial Sequence
  Description of Artificial Sequence: Synthetic oligonucleotide
agggacagccgcuggaacu

SEQ ID NO: 7657 - RNA, 19 nt, Artificial Sequence
  Description of Artificial Sequence: Synthetic oligonucleotide
cagggacagccgcuggaac

SEQ ID NO: 7658 - RNA, 19 nt, Artificial Sequence
  Description of Artificial Sequence: Synthetic oligonucleotide
gcagggacagccgcuggaa

SEQ ID NO: 7659 - RNA, 19 nt, Artificial Sequence
  Description of Artificial Sequence: Synthetic oligonucleotide
cgcagggacagccgcugga

SEQ ID NO: 7660 - RNA, 19 nt, Artificial Sequence
  Description of Artificial Sequence: Synthetic oligonucleotide
ccgcagggacagccgcugg

SEQ ID NO: 7661 - RNA, 19 nt, Artificial Sequence
  Description of Artificial Sequence: Synthetic oligonucleotide
gccgcagggacagccgcug

SEQ ID NO: 7662 - RNA, 19 nt, Artificial Sequence
  Description of Artificial Sequence: Synthetic oligonucleotide
ugccgcagggacagccgcu

SEQ ID NO: 7663 - RNA, 19 nt, Artificial Sequence
  Description of Artificial Sequence: Synthetic oligonucleotide
cugccgcagggacagccgc

SEQ ID NO: 7664 - RNA, 19 nt, Artificial Sequence
  Description of Artificial Sequence: Synthetic oligonucleotide
ucugccgcagggacagccg

SEQ ID NO: 7665 - RNA, 19 nt, Artificial Sequence
  Description of Artificial Sequence: Synthetic oligonucleotide
cucugccgcagggacagcc

SEQ ID NO: 7666 - RNA, 19 nt, Artificial Sequence
  Description of Artificial Sequence: Synthetic oligonucleotide
ccucugccgcagggacagc

SEQ ID NO: 7667 - RNA, 19 nt, Artificial Sequence
  Description of Artificial Sequence: Synthetic oligonucleotide
gccucugccgcagggacag

SEQ ID NO: 7668 - RNA, 19 nt, Artificial Sequence
  Description of Artificial Sequence: Synthetic oligonucleotide
agccucugccgcagggaca

SEQ ID NO: 7669 - RNA, 19 nt, Artificial Sequence
  Description of Artificial Sequence: Synthetic oligonucleotide
cagccucugccgcagggac

SEQ ID NO: 7670 - RNA, 19 nt, Artificial Sequence
  Description of Artificial Sequence: Synthetic oligonucleotide
ucagccucugccgcaggga

SEQ ID NO: 7671 - RNA, 19 nt, Artificial Sequence
  Description of Artificial Sequence: Synthetic oligonucleotide
cucagccucugccgcaggg

SEQ ID NO: 7672 - RNA, 19 nt, Artificial Sequence
  Description of Artificial Sequence: Synthetic oligonucleotide
ccucagccucugccgcagg

SEQ ID NO: 7673 - RNA, 19 nt, Artificial Sequence
  Description of Artificial Sequence: Synthetic oligonucleotide
gccucagccucugccgcag

SEQ ID NO: 7674 - RNA, 19 nt, Artificial Sequence
  Description of Artificial Sequence: Synthetic oligonucleotide
ggccucagccucugccgca

SEQ ID NO: 7675 - RNA, 19 nt, Artificial Sequence
  Description of Artificial Sequence: Synthetic oligonucleotide
cggccucagccucugccgc

SEQ ID NO: 7676 - RNA, 19 nt, Artificial Sequence
  Description of Artificial Sequence: Synthetic oligonucleotide
ucggccucagccucugccg

SEQ ID NO: 7677 - RNA, 19 nt, Artificial Sequence
  Description of Artificial Sequence: Synthetic oligonucleotide
cucggccucagccucugcc

SEQ ID NO: 7678 - RNA, 19 nt, Artificial Sequence
  Description of Artificial Sequence: Synthetic oligonucleotide
ccucggccucagccucugc

SEQ ID NO: 7679 - RNA, 19 nt, Artificial Sequence
  Description of Artificial Sequence: Synthetic oligonucleotide
accucggccucagccucug

SEQ ID NO: 7680 - RNA, 19 nt, Artificial Sequence
  Description of Artificial Sequence: Synthetic oligonucleotide
caccucggccucagccucu

SEQ ID NO: 7681 - RNA, 19 nt, Artificial Sequence
  Description of Artificial Sequence: Synthetic oligonucleotide
ucaccucggccucagccuc

SEQ ID NO: 7682 - RNA, 19 nt, Artificial Sequence
  Description of Artificial Sequence: Synthetic oligonucleotide
gucaccucggccucagccu

SEQ ID NO: 7683 - RNA, 19 nt, Artificial Sequence
  Description of Artificial Sequence: Synthetic oligonucleotide
cgucaccucggccucagcc

SEQ ID NO: 7684 - RNA, 19 nt, Artificial Sequence
  Description of Artificial Sequence: Synthetic oligonucleotide
gcgucaccucggccucagc

SEQ ID NO: 7685 - RNA, 19 nt, Artificial Sequence
  Description of Artificial Sequence: Synthetic oligonucleotide
agcgucaccucggccucag

SEQ ID NO: 7686 - RNA, 19 nt, Artificial Sequence
  Description of Artificial Sequence: Synthetic oligonucleotide
cagcgucaccucggccuca

SEQ ID NO: 7687 - RNA, 19 nt, Artificial Sequence
  Description of Artificial Sequence: Synthetic oligonucleotide
gcagcgucaccucggccuc

SEQ ID NO: 7688 - RNA, 19 nt, Artificial Sequence
  Description of Artificial Sequence: Synthetic oligonucleotide
cgcagcgucaccucggccu

SEQ ID NO: 7689 - RNA, 19 nt, Artificial Sequence
  Description of Artificial Sequence: Synthetic oligonucleotide
ccgcagcgucaccucggcc

SEQ ID NO: 7690 - RNA, 19 nt, Artificial Sequence
  Description of Artificial Sequence: Synthetic oligonucleotide
cccgcagcgucaccucggc

SEQ ID NO: 7691 - RNA, 19 nt, Artificial Sequence
  Description of Artificial Sequence: Synthetic oligonucleotide
ucccgcagcgucaccucgg

SEQ ID NO: 7692 - RNA, 19 nt, Artificial Sequence
  Description of Artificial Sequence: Synthetic oligonucleotide
cucccgcagcgucaccucg

SEQ ID NO: 7693 - RNA, 19 nt, Artificial Sequence
  Description of Artificial Sequence: Synthetic oligonucleotide
gcucccgcagcgucaccuc

SEQ ID NO: 7694 - RNA, 19 nt, Artificial Sequence
  Description of Artificial Sequence: Synthetic oligonucleotide
agcucccgcagcgucaccu

SEQ ID NO: 7695 - RNA, 19 nt, Artificial Sequence
  Description of Artificial Sequence: Synthetic oligonucleotide
gagcucccgcagcgucacc

SEQ ID NO: 7696 - RNA, 19 nt, Artificial Sequence
  Description of Artificial Sequence: Synthetic oligonucleotide
ggagcucccgcagcgucac

SEQ ID NO: 7697 - RNA, 19 nt, Artificial Sequence
  Description of Artificial Sequence: Synthetic oligonucleotide
uggagcucccgcagcguca

SEQ ID NO: 7698 - RNA, 19 nt, Artificial Sequence
  Description of Artificial Sequence: Synthetic oligonucleotide
cuggagcucccgcagcguc

SEQ ID NO: 7699 - RNA, 19 nt, Artificial Sequence
  Description of Artificial Sequence: Synthetic oligonucleotide
ccuggagcucccgcagcgu

SEQ ID NO: 7700 - RNA, 19 nt, Artificial Sequence
  Description of Artificial Sequence: Synthetic oligonucleotide
uccuggagcucccgcagcg

SEQ ID NO: 7701 - RNA, 19 nt, Artificial Sequence
  Description of Artificial Sequence: Synthetic oligonucleotide
uuccuggagcucccgcagc

SEQ ID NO: 7702 - RNA, 19 nt, Artificial Sequence
  Description of Artificial Sequence: Synthetic oligonucleotide
cuuccuggagcucccgcag

SEQ ID NO: 7703 - RNA, 19 nt, Artificial Sequence
  Description of Artificial Sequence: Synthetic oligonucleotide
gcuuccuggagcucccgca

SEQ ID NO: 7704 - RNA, 19 nt, Artificial Sequence
  Description of Artificial Sequence: Synthetic oligonucleotide
ggcuuccuggagcucccgc

SEQ ID NO: 7705 - RNA, 19 nt, Artificial Sequence
  Description of Artificial Sequence: Synthetic oligonucleotide
gggcuuccuggagcucccg

SEQ ID NO: 7706 - RNA, 19 nt, Artificial Sequence
  Description of Artificial Sequence: Synthetic oligonucleotide
agggcuuccuggagcuccc

SEQ ID NO: 7707 - RNA, 19 nt, Artificial Sequence
  Description of Artificial Sequence: Synthetic oligonucleotide
cagggcuuccuggagcucc

SEQ ID NO: 7708 - RNA, 19 nt, Artificial Sequence
  Description of Artificial Sequence: Synthetic oligonucleotide
ccagggcuuccuggagcuc

SEQ ID NO: 7709 - RNA, 19 nt, Artificial Sequence
  Description of Artificial Sequence: Synthetic oligonucleotide
uccagggcuuccuggagcu

SEQ ID NO: 7710 - RNA, 19 nt, Artificial Sequence
  Description of Artificial Sequence: Synthetic oligonucleotide
cuccagggcuuccuggagc

SEQ ID NO: 7711 - RNA, 19 nt, Artificial Sequence
  Description of Artificial Sequence: Synthetic oligonucleotide
ccuccagggcuuccuggag

SEQ ID NO: 7712 - RNA, 19 nt, Artificial Sequence
  Description of Artificial Sequence: Synthetic oligonucleotide
uccuccagggcuuccugga

SEQ ID NO: 7713 - RNA, 19 nt, Artificial Sequence
  Description of Artificial Sequence: Synthetic oligonucleotide
cuccuccagggcuuccugg

SEQ ID NO: 7714 - RNA, 19 nt, Artificial Sequence
  Description of Artificial Sequence: Synthetic oligonucleotide
ccuccuccagggcuuccug

SEQ ID NO: 7715 - RNA, 19 nt, Artificial Sequence
  Description of Artificial Sequence: Synthetic oligonucleotide
uccuccuccagggcuuccu

SEQ ID NO: 7716 - RNA, 19 nt, Artificial Sequence
  Description of Artificial Sequence: Synthetic oligonucleotide
cuccuccuccagggcuucc

SEQ ID NO: 7717 - RNA, 19 nt, Artificial Sequence
  Description of Artificial Sequence: Synthetic oligonucleotide
ccuccuccuccagggcuuc

SEQ ID NO: 7718 - RNA, 19 nt, Artificial Sequence
  Description of Artificial Sequence: Synthetic oligonucleotide
accuccuccuccagggcuu

SEQ ID NO: 7719 - RNA, 19 nt, Artificial Sequence
  Description of Artificial Sequence: Synthetic oligonucleotide
caccuccuccuccagggcu

SEQ ID NO: 7720 - RNA, 19 nt, Artificial Sequence
  Description of Artificial Sequence: Synthetic oligonucleotide
gcaccuccuccuccagggc

SEQ ID NO: 7721 - RNA, 19 nt, Artificial Sequence
  Description of Artificial Sequence: Synthetic oligonucleotide
agcaccuccuccuccaggg

SEQ ID NO: 7722 - RNA, 19 nt, Artificial Sequence
  Description of Artificial Sequence: Synthetic oligonucleotide
gagcaccuccuccuccagg

SEQ ID NO: 7723 - RNA, 19 nt, Artificial Sequence
  Description of Artificial Sequence: Synthetic oligonucleotide
ugagcaccuccuccuccag

SEQ ID NO: 7724 - RNA, 19 nt, Artificial Sequence
  Description of Artificial Sequence: Synthetic oligonucleotide
gugagcaccuccuccucca

SEQ ID NO: 7725 - RNA, 19 nt, Artificial Sequence
  Description of Artificial Sequence: Synthetic oligonucleotide
ggugagcaccuccuccucc

SEQ ID NO: 7726 - RNA, 19 nt, Artificial Sequence
  Description of Artificial Sequence: Synthetic oligonucleotide
gggugagcaccuccuccuc

SEQ ID NO: 7727 - RNA, 19 nt, Artificial Sequence
  Description of Artificial Sequence: Synthetic oligonucleotide
cgggugagcaccuccuccu

SEQ ID NO: 7728 - RNA, 19 nt, Artificial Sequence
  Description of Artificial Sequence: Synthetic oligonucleotide
ccgggugagcaccuccucc

SEQ ID NO: 7729 - RNA, 19 nt, Artificial Sequence
  Description of Artificial Sequence: Synthetic oligonucleotide
gccgggugagcaccuccuc

SEQ ID NO: 7730 - RNA, 19 nt, Artificial Sequence
  Description of Artificial Sequence: Synthetic oligonucleotide
ugccgggugagcaccuccu

SEQ ID NO: 7731 - RNA, 19 nt, Artificial Sequence
  Description of Artificial Sequence: Synthetic oligonucleotide
cugccgggugagcaccucc

SEQ ID NO: 7732 - RNA, 19 nt, Artificial Sequence
  Description of Artificial Sequence: Synthetic oligonucleotide
ucugccgggugagcaccuc

SEQ ID NO: 7733 - RNA, 19 nt, Artificial Sequence
  Description of Artificial Sequence: Synthetic oligonucleotide
cucugccgggugagcaccu

SEQ ID NO: 7734 - RNA, 19 nt, Artificial Sequence
  Description of Artificial Sequence: Synthetic oligonucleotide
gcucugccgggugagcacc

SEQ ID NO: 7735 - RNA, 19 nt, Artificial Sequence
  Description of Artificial Sequence: Synthetic oligonucleotide
ggcucugccgggugagcac

SEQ ID NO: 7736 - RNA, 19 nt, Artificial Sequence
  Description of Artificial Sequence: Synthetic oligonucleotide
aggcucugccgggugagca

SEQ ID NO: 7737 - RNA, 19 nt, Artificial Sequence
  Description of Artificial Sequence: Synthetic oligonucleotide
caggcucugccgggugagc

SEQ ID NO: 7738 - RNA, 19 nt, Artificial Sequence
  Description of Artificial Sequence: Synthetic oligonucleotide
ucaggcucugccgggugag

SEQ ID NO: 7739 - RNA, 19 nt, Artificial Sequence
  Description of Artificial Sequence: Synthetic oligonucleotide
cucaggcucugccggguga

SEQ ID NO: 7740 - RNA, 19 nt, Artificial Sequence
  Description of Artificial Sequence: Synthetic oligonucleotide
gcucaggcucugccgggug

SEQ ID NO: 7741 - RNA, 19 nt, Artificial Sequence
  Description of Artificial Sequence: Synthetic oligonucleotide
ggcucaggcucugccgggu

SEQ ID NO: 7742 - RNA, 19 nt, Artificial Sequence
  Description of Artificial Sequence: Synthetic oligonucleotide
cggcucaggcucugccggg

SEQ ID NO: 7743 - RNA, 19 nt, Artificial Sequence
  Description of Artificial Sequence: Synthetic oligonucleotide
ccggcucaggcucugccgg

SEQ ID NO: 7744 - RNA, 19 nt, Artificial Sequence
  Description of Artificial Sequence: Synthetic oligonucleotide
cccggcucaggcucugccg

SEQ ID NO: 7745 - RNA, 19 nt, Artificial Sequence
  Description of Artificial Sequence: Synthetic oligonucleotide
ucccggcucaggcucugcc

SEQ ID NO: 7746 - RNA, 19 nt, Artificial Sequence
  Description of Artificial Sequence: Synthetic oligonucleotide
cucccggcucaggcucugc

SEQ ID NO: 7747 - RNA, 19 nt, Artificial Sequence
  Description of Artificial Sequence: Synthetic oligonucleotide
ucucccggcucaggcucug

SEQ ID NO: 7748 - RNA, 19 nt, Artificial Sequence
  Description of Artificial Sequence: Synthetic oligonucleotide
aucucccggcucaggcucu

SEQ ID NO: 7749 - RNA, 19 nt, Artificial Sequence
  Description of Artificial Sequence: Synthetic oligonucleotide
caucucccggcucaggcuc

SEQ ID NO: 7750 - RNA, 19 nt, Artificial Sequence
  Description of Artificial Sequence: Synthetic oligonucleotide
ccaucucccggcucaggcu

SEQ ID NO: 7751 - RNA, 19 nt, Artificial Sequence
  Description of Artificial Sequence: Synthetic oligonucleotide
uccaucucccggcucaggc

SEQ ID NO: 7752 - RNA, 19 nt, Artificial Sequence
  Description of Artificial Sequence: Synthetic oligonucleotide
cuccaucucccggcucagg

SEQ ID NO: 7753 - RNA, 19 nt, Artificial Sequence
  Description of Artificial Sequence: Synthetic oligonucleotide
ccuccaucucccggcucag

SEQ ID NO: 7754 - RNA, 19 nt, Artificial Sequence
  Description of Artificial Sequence: Synthetic oligonucleotide
gccuccaucucccggcuca

SEQ ID NO: 7755 - RNA, 19 nt, Artificial Sequence
  Description of Artificial Sequence: Synthetic oligonucleotide
ggccuccaucucccggcuc

SEQ ID NO: 7756 - RNA, 19 nt, Artificial Sequence
  Description of Artificial Sequence: Synthetic oligonucleotide
uggccuccaucucccggcu

SEQ ID NO: 7757 - RNA, 19 nt, Artificial Sequence
  Description of Artificial Sequence: Synthetic oligonucleotide
auggccuccaucucccggc

SEQ ID NO: 7758 - RNA, 19 nt, Artificial Sequence
  Description of Artificial Sequence: Synthetic oligonucleotide
gauggccuccaucucccgg

SEQ ID NO: 7759 - RNA, 19 nt, Artificial Sequence
  Description of Artificial Sequence: Synthetic oligonucleotide
ggauggccuccaucucccg

SEQ ID NO: 7760 - RNA, 19 nt, Artificial Sequence
  Description of Artificial Sequence: Synthetic oligonucleotide
cggauggccuccaucuccc

SEQ ID NO: 7761 - RNA, 19 nt, Artificial Sequence
  Description of Artificial Sequence: Synthetic oligonucleotide
gcggauggccuccaucucc

SEQ ID NO: 7762 - RNA, 19 nt, Artificial Sequence
  Description of Artificial Sequence: Synthetic oligonucleotide
ugcggauggccuccaucuc

SEQ ID NO: 7763 - RNA, 19 nt, Artificial Sequence
  Description of Artificial Sequence: Synthetic oligonucleotide
gugcggauggccuccaucu

SEQ ID NO: 7764 - RNA, 19 nt, Artificial Sequence
  Description of Artificial Sequence: Synthetic oligonucleotide
cgugcggauggccuccauc

SEQ ID NO: 7765 - RNA, 19 nt, Artificial Sequence
  Description of Artificial Sequence: Synthetic oligonucleotide
ccgugcggauggccuccau

SEQ ID NO: 7766 - RNA, 19 nt, Artificial Sequence
  Description of Artificial Sequence: Synthetic oligonucleotide
uccgugcggauggccucca

SEQ ID NO: 7767 - RNA, 19 nt, Artificial Sequence
  Description of Artificial Sequence: Synthetic oligonucleotide
guccgugcggauggccucc

SEQ ID NO: 7768 - RNA, 19 nt, Artificial Sequence
  Description of Artificial Sequence: Synthetic oligonucleotide
uguccgugcggauggccuc

SEQ ID NO: 7769 - RNA, 19 nt, Artificial Sequence
  Description of Artificial Sequence: Synthetic oligonucleotide
uuguccgugcggauggccu

SEQ ID NO: 7770 - RNA, 19 nt, Artificial Sequence
  Description of Artificial Sequence: Synthetic oligonucleotide
guuguccgugcggauggcc

SEQ ID NO: 7771 - RNA, 19 nt, Artificial Sequence
  Description of Artificial Sequence: Synthetic oligonucleotide
gguuguccgugcggauggc

SEQ ID NO: 7772 - RNA, 19 nt, Artificial Sequence
  Description of Artificial Sequence: Synthetic oligonucleotide
ugguuguccgugcggaugg

SEQ ID NO: 7773 - RNA, 19 nt, Artificial Sequence
  Description of Artificial Sequence: Synthetic oligonucleotide
cugguuguccgugcggaug

SEQ ID NO: 7774 - RNA, 19 nt, Artificial Sequence
  Description of Artificial Sequence: Synthetic oligonucleotide
ucugguuguccgugcggau

SEQ ID NO: 7775 - RNA, 19 nt, Artificial Sequence
  Description of Artificial Sequence: Synthetic oligonucleotide
uucugguuguccgugcgga

SEQ ID NO: 7776 - RNA, 19 nt, Artificial Sequence
  Description of Artificial Sequence: Synthetic oligonucleotide
guucugguuguccgugcgg

SEQ ID NO: 7777 - RNA, 19 nt, Artificial Sequence
  Description of Artificial Sequence: Synthetic oligonucleotide
aguucugguuguccgugcg

SEQ ID NO: 7778 - RNA, 19 nt, Artificial Sequence
  Description of Artificial Sequence: Synthetic oligonucleotide
aaguucugguuguccgugc

SEQ ID NO: 7779 - RNA, 19 nt, Artificial Sequence
  Description of Artificial Sequence: Synthetic oligonucleotide
gaaguucugguuguccgug

SEQ ID NO: 7780 - RNA, 19 nt, Artificial Sequence
  Description of Artificial Sequence: Synthetic oligonucleotide
cgaaguucugguuguccgu

SEQ ID NO: 7781 - RNA, 19 nt, Artificial Sequence
  Description of Artificial Sequence: Synthetic oligonucleotide
gcgaaguucugguuguccg

SEQ ID NO: 7782 - RNA, 19 nt, Artificial Sequence
  Description of Artificial Sequence: Synthetic oligonucleotide
ggcgaaguucugguugucc

SEQ ID NO: 7783 - RNA, 19 nt, Artificial Sequence
  Description of Artificial Sequence: Synthetic oligonucleotide
uggcgaaguucugguuguc

SEQ ID NO: 7784 - RNA, 19 nt, Artificial Sequence
  Description of Artificial Sequence: Synthetic oligonucleotide
cuggcgaaguucugguugu

SEQ ID NO: 7785 - RNA, 19 nt, Artificial Sequence
  Description of Artificial Sequence: Synthetic oligonucleotide
acuggcgaaguucugguug

SEQ ID NO: 7786 - RNA, 19 nt, Artificial Sequence
  Description of Artificial Sequence: Synthetic oligonucleotide
gacuggcgaaguucugguu

SEQ ID NO: 7787 - RNA, 19 nt, Artificial Sequence
  Description of Artificial Sequence: Synthetic oligonucleotide
ugacuggcgaaguucuggu

SEQ ID NO: 7788 - RNA, 19 nt, Artificial Sequence
  Description of Artificial Sequence: Synthetic oligonucleotide
uugacuggcgaaguucugg

SEQ ID NO: 7789 - RNA, 19 nt, Artificial Sequence
  Description of Artificial Sequence: Synthetic oligonucleotide
guugacuggcgaaguucug

SEQ ID NO: 7790 - RNA, 19 nt, Artificial Sequence
  Description of Artificial Sequence: Synthetic oligonucleotide
aguugacuggcgaaguucu

SEQ ID NO: 7791 - RNA, 19 nt, Artificial Sequence
  Description of Artificial Sequence: Synthetic oligonucleotide
uaguugacuggcgaaguuc

SEQ ID NO: 7792 - RNA, 19 nt, Artificial Sequence
  Description of Artificial Sequence: Synthetic oligonucleotide
guaguugacuggcgaaguu

SEQ ID NO: 7793 - RNA, 19 nt, Artificial Sequence
  Description of Artificial Sequence: Synthetic oligonucleotide
cguaguugacuggcgaagu

SEQ ID NO: 7794 - RNA, 19 nt, Artificial Sequence
  Description of Artificial Sequence: Synthetic oligonucleotide
gcguaguugacuggcgaag

SEQ ID NO: 7795 - RNA, 19 nt, Artificial Sequence
  Description of Artificial Sequence: Synthetic oligonucleotide
cgcguaguugacuggcgaa

SEQ ID NO: 7796 - RNA, 19 nt, Artificial Sequence
  Description of Artificial Sequence: Synthetic oligonucleotide
ucgcguaguugacuggcga

SEQ ID NO: 7797 - RNA, 19 nt, Artificial Sequence
  Description of Artificial Sequence: Synthetic oligonucleotide
cucgcguaguugacuggcg

SEQ ID NO: 7798 - RNA, 19 nt, Artificial Sequence
  Description of Artificial Sequence: Synthetic oligonucleotide
ccucgcguaguugacuggc

SEQ ID NO: 7799 - RNA, 19 nt, Artificial Sequence
  Description of Artificial Sequence: Synthetic oligonucleotide
gccucgcguaguugacugg

SEQ ID NO: 7800 - RNA, 19 nt, Artificial Sequence
  Description of Artificial Sequence: Synthetic oligonucleotide
ugccucgcguaguugacug

SEQ ID NO: 7801 - RNA, 19 nt, Artificial Sequence
  Description of Artificial Sequence: Synthetic oligonucleotide
cugccucgcguaguugacu

SEQ ID NO: 7802 - RNA, 19 nt, Artificial Sequence
  Description of Artificial Sequence: Synthetic oligonucleotide
ucugccucgcguaguugac

SEQ ID NO: 7803 - RNA, 19 nt, Artificial Sequence
  Description of Artificial Sequence: Synthetic oligonucleotide
cucugccucgcguaguuga

SEQ ID NO: 7804 - RNA, 19 nt, Artificial Sequence
  Description of Artificial Sequence: Synthetic oligonucleotide
ccucugccucgcguaguug

SEQ ID NO: 7805 - RNA, 19 nt, Artificial Sequence
  Description of Artificial Sequence: Synthetic oligonucleotide
gccucugccucgcguaguu

SEQ ID NO: 7806 - RNA, 19 nt, Artificial Sequence
  Description of Artificial Sequence: Synthetic oligonucleotide
agccucugccucgcguagu

SEQ ID NO: 7807 - RNA, 19 nt, Artificial Sequence
  Description of Artificial Sequence: Synthetic oligonucleotide
gagccucugccucgcguag

SEQ ID NO: 7808 - RNA, 19 nt, Artificial Sequence
  Description of Artificial Sequence: Synthetic oligonucleotide
cgagccucugccucgcgua

SEQ ID NO: 7809 - RNA, 19 nt, Artificial Sequence
  Description of Artificial Sequence: Synthetic oligonucleotide
ccgagccucugccucgcgu

SEQ ID NO: 7810 - RNA, 19 nt, Artificial Sequence
  Description of Artificial Sequence: Synthetic oligonucleotide
uccgagccucugccucgcg

SEQ ID NO: 7811 - RNA, 19 nt, Artificial Sequence
  Description of Artificial Sequence: Synthetic oligonucleotide
uuccgagccucugccucgc

SEQ ID NO: 7812 - RNA, 19 nt, Artificial Sequence
  Description of Artificial Sequence: Synthetic oligonucleotide
guuccgagccucugccucg

SEQ ID NO: 7813 - RNA, 19 nt, Artificial Sequence
  Description of Artificial Sequence: Synthetic oligonucleotide
gguuccgagccucugccuc

SEQ ID NO: 7814 - RNA, 19 nt, Artificial Sequence
  Description of Artificial Sequence: Synthetic oligonucleotide
cgguuccgagccucugccu

SEQ ID NO: 7815 - RNA, 19 nt, Artificial Sequence
  Description of Artificial Sequence: Synthetic oligonucleotide
ccgguuccgagccucugcc

SEQ ID NO: 7816 - RNA, 19 nt, Artificial Sequence
  Description of Artificial Sequence: Synthetic oligonucleotide
cccgguuccgagccucugc

SEQ ID NO: 7817 - RNA, 19 nt, Artificial Sequence
  Description of Artificial Sequence: Synthetic oligonucleotide
ucccgguuccgagccucug

SEQ ID NO: 7818 - RNA, 19 nt, Artificial Sequence
  Description of Artificial Sequence: Synthetic oligonucleotide
gucccgguuccgagccucu

SEQ ID NO: 7819 - RNA, 19 nt, Artificial Sequence
  Description of Artificial Sequence: Synthetic oligonucleotide
ggucccgguuccgagccuc

SEQ ID NO: 7820 - RNA, 19 nt, Artificial Sequence
  Description of Artificial Sequence: Synthetic oligonucleotide
aggucccgguuccgagccu

SEQ ID NO: 7821 - RNA, 19 nt, Artificial Sequence
  Description of Artificial Sequence: Synthetic oligonucleotide
uaggucccgguuccgagcc

SEQ ID NO: 7822 - RNA, 19 nt, Artificial Sequence
  Description of Artificial Sequence: Synthetic oligonucleotide
cuaggucccgguuccgagc

SEQ ID NO: 7823 - RNA, 19 nt, Artificial Sequence
  Description of Artificial Sequence: Synthetic oligonucleotide
ucuaggucccgguuccgag

SEQ ID NO: 7824 - RNA, 19 nt, Artificial Sequence
  Description of Artificial Sequence: Synthetic oligonucleotide
cucuaggucccgguuccga

SEQ ID NO: 7825 - RNA, 19 nt, Artificial Sequence
  Description of Artificial Sequence: Synthetic oligonucleotide
ccucuaggucccgguuccg

SEQ ID NO: 7826 - RNA, 19 nt, Artificial Sequence
  Description of Artificial Sequence: Synthetic oligonucleotide
gccucuaggucccgguucc

SEQ ID NO: 7827 - RNA, 19 nt, Artificial Sequence
  Description of Artificial Sequence: Synthetic oligonucleotide
ugccucuaggucccgguuc

SEQ ID NO: 7828 - RNA, 19 nt, Artificial Sequence
  Description of Artificial Sequence: Synthetic oligonucleotide
gugccucuaggucccgguu

SEQ ID NO: 7829 - RNA, 19 nt, Artificial Sequence
  Description of Artificial Sequence: Synthetic oligonucleotide
ugugccucuaggucccggu

SEQ ID NO: 7830 - RNA, 19 nt, Artificial Sequence
  Description of Artificial Sequence: Synthetic oligonucleotide
gugugccucuaggucccgg

SEQ ID NO: 7831 - RNA, 19 nt, Artificial Sequence
  Description of Artificial Sequence: Synthetic oligonucleotide
cgugugccucuaggucccg

SEQ ID NO: 7832 - RNA, 19 nt, Artificial Sequence
  Description of Artificial Sequence: Synthetic oligonucleotide
acgugugccucuagguccc

SEQ ID NO: 7833 - RNA, 19 nt, Artificial Sequence
  Description of Artificial Sequence: Synthetic oligonucleotide
gacgugugccucuaggucc

SEQ ID NO: 7834 - RNA, 19 nt, Artificial Sequence
  Description of Artificial Sequence: Synthetic oligonucleotide
ggacgugugccucuagguc

SEQ ID NO: 7835 - RNA, 19 nt, Artificial Sequence
  Description of Artificial Sequence: Synthetic oligonucleotide
cggacgugugccucuaggu

SEQ ID NO: 7836 - RNA, 19 nt, Artificial Sequence
  Description of Artificial Sequence: Synthetic oligonucleotide
ccggacgugugccucuagg

SEQ ID NO: 7837 - RNA, 19 nt, Artificial Sequence
  Description of Artificial Sequence: Synthetic oligonucleotide
gccggacgugugccucuag

SEQ ID NO: 7838 - RNA, 19 nt, Artificial Sequence
  Description of Artificial Sequence: Synthetic oligonucleotide
ugccggacgugugccucua

SEQ ID NO: 7839 - RNA, 19 nt, Artificial Sequence
  Description of Artificial Sequence: Synthetic oligonucleotide
cugccggacgugugccucu

SEQ ID NO: 7840 - RNA, 19 nt, Artificial Sequence
  Description of Artificial Sequence: Synthetic oligonucleotide
acugccggacgugugccuc

SEQ ID NO: 7841 - RNA, 19 nt, Artificial Sequence
  Description of Artificial Sequence: Synthetic oligonucleotide
aacugccggacgugugccu

SEQ ID NO: 7842 - RNA, 19 nt, Artificial Sequence
  Description of Artificial Sequence: Synthetic oligonucleotide
caacugccggacgugugcc

SEQ ID NO: 7843 - RNA, 19 nt, Artificial Sequence
  Description of Artificial Sequence: Synthetic oligonucleotide
gcaacugccggacgugugc

SEQ ID NO: 7844 - RNA, 19 nt, Artificial Sequence
  Description of Artificial Sequence: Synthetic oligonucleotide
ugcaacugccggacgugug

SEQ ID NO: 7845 - RNA, 19 nt, Artificial Sequence
  Description of Artificial Sequence: Synthetic oligonucleotide
cugcaacugccggacgugu

SEQ ID NO: 7846 - RNA, 19 nt, Artificial Sequence
  Description of Artificial Sequence: Synthetic oligonucleotide
ccugcaacugccggacgug

SEQ ID NO: 7847 - RNA, 19 nt, Artificial Sequence
  Description of Artificial Sequence: Synthetic oligonucleotide
uccugcaacugccggacgu

SEQ ID NO: 7848 - RNA, 19 nt, Artificial Sequence
  Description of Artificial Sequence: Synthetic oligonucleotide
cuccugcaacugccggacg

SEQ ID NO: 7849 - RNA, 19 nt, Artificial Sequence
  Description of Artificial Sequence: Synthetic oligonucleotide
gcuccugcaacugccggac

SEQ ID NO: 7850 - RNA, 19 nt, Artificial Sequence
  Description of Artificial Sequence: Synthetic oligonucleotide
cgcuccugcaacugccgga

SEQ ID NO: 7851 - RNA, 19 nt, Artificial Sequence
  Description of Artificial Sequence: Synthetic oligonucleotide
ccgcuccugcaacugccgg

SEQ ID NO: 7852 - RNA, 19 nt, Artificial Sequence
  Description of Artificial Sequence: Synthetic oligonucleotide
uccgcuccugcaacugccg

SEQ ID NO: 7853 - RNA, 19 nt, Artificial Sequence
  Description of Artificial Sequence: Synthetic oligonucleotide
auccgcuccugcaacugcc

SEQ ID NO: 7854 - RNA, 19 nt, Artificial Sequence
  Description of Artificial Sequence: Synthetic oligonucleotide
cauccgcuccugcaacugc

SEQ ID NO: 7855 - RNA, 19 nt, Artificial Sequence
  Description of Artificial Sequence: Synthetic oligonucleotide
ccauccgcuccugcaacug

SEQ ID NO: 7856 - RNA, 19 nt, Artificial Sequence
  Description of Artificial Sequence: Synthetic oligonucleotide
uccauccgcuccugcaacu

SEQ ID NO: 7857 - RNA, 19 nt, Artificial Sequence
  Description of Artificial Sequence: Synthetic oligonucleotide
cuccauccgcuccugcaac

SEQ ID NO: 7858 - RNA, 19 nt, Artificial Sequence
  Description of Artificial Sequence: Synthetic oligonucleotide
acuccauccgcuccugcaa

SEQ ID NO: 7859 - RNA, 19 nt, Artificial Sequence
  Description of Artificial Sequence: Synthetic oligonucleotide
aacuccauccgcuccugca

SEQ ID NO: 7860 - RNA, 19 nt, Artificial Sequence
  Description of Artificial Sequence: Synthetic oligonucleotide
caacuccauccgcuccugc

SEQ ID NO: 7861 - RNA, 19 nt, Artificial Sequence
  Description of Artificial Sequence: Synthetic oligonucleotide
gcaacuccauccgcuccug

SEQ ID NO: 7862 - RNA, 19 nt, Artificial Sequence
  Description of Artificial Sequence: Synthetic oligonucleotide
agcaacuccauccgcuccu

SEQ ID NO: 7863 - RNA, 19 nt, Artificial Sequence
  Description of Artificial Sequence: Synthetic oligonucleotide
cagcaacuccauccgcucc

SEQ ID NO: 7864 - RNA, 19 nt, Artificial Sequence
  Description of Artificial Sequence: Synthetic oligonucleotide
gcagcaacuccauccgcuc

SEQ ID NO: 7865 - RNA, 19 nt, Artificial Sequence
  Description of Artificial Sequence: Synthetic oligonucleotide
ugcagcaacuccauccgcu

SEQ ID NO: 7866 - RNA, 19 nt, Artificial Sequence
  Description of Artificial Sequence: Synthetic oligonucleotide
cugcagcaacuccauccgc

SEQ ID NO: 7867 - RNA, 19 nt, Artificial Sequence
  Description of Artificial Sequence: Synthetic oligonucleotide
ccugcagcaacuccauccg

SEQ ID NO: 7868 - RNA, 19 nt, Artificial Sequence
  Description of Artificial Sequence: Synthetic oligonucleotide
gccugcagcaacuccaucc

SEQ ID NO: 7869 - RNA, 19 nt, Artificial Sequence
  Description of Artificial Sequence: Synthetic oligonucleotide
ugccugcagcaacuccauc

SEQ ID NO: 7870 - RNA, 19 nt, Artificial Sequence
  Description of Artificial Sequence: Synthetic oligonucleotide
cugccugcagcaacuccau

SEQ ID NO: 7871 - RNA, 19 nt, Artificial Sequence
  Description of Artificial Sequence: Synthetic oligonucleotide
ucugccugcagcaacucca

SEQ ID NO: 7872 - RNA, 19 nt, Artificial Sequence
  Description of Artificial Sequence: Synthetic oligonucleotide
cucugccugcagcaacucc

SEQ ID NO: 7873 - RNA, 19 nt, Artificial Sequence
  Description of Artificial Sequence: Synthetic oligonucleotide
ccucugccugcagcaacuc

SEQ ID NO: 7874 - RNA, 19 nt, Artificial Sequence
  Description of Artificial Sequence: Synthetic oligonucleotide
cccucugccugcagcaacu

SEQ ID NO: 7875 - RNA, 19 nt, Artificial Sequence
  Description of Artificial Sequence: Synthetic oligonucleotide
ucccucugccugcagcaac

SEQ ID NO: 7876 - RNA, 19 nt, Artificial Sequence
  Description of Artificial Sequence: Synthetic oligonucleotide
cucccucugccugcagcaa

SEQ ID NO: 7877 - RNA, 19 nt, Artificial Sequence
  Description of Artificial Sequence: Synthetic oligonucleotide
gcucccucugccugcagca

SEQ ID NO: 7878 - RNA, 19 nt, Artificial Sequence
  Description of Artificial Sequence: Synthetic oligonucleotide
ggcucccucugccugcagc

SEQ ID NO: 7879 - RNA, 19 nt, Artificial Sequence
  Description of Artificial Sequence: Synthetic oligonucleotide
uggcucccucugccugcag

SEQ ID NO: 7880 - RNA, 19 nt, Artificial Sequence
  Description of Artificial Sequence: Synthetic oligonucleotide
guggcucccucugccugca

SEQ ID NO: 7881 - RNA, 19 nt, Artificial Sequence
  Description of Artificial Sequence: Synthetic oligonucleotide
uguggcucccucugccugc

SEQ ID NO: 7882 - RNA, 19 nt, Artificial Sequence
  Description of Artificial Sequence: Synthetic oligonucleotide
cuguggcucccucugccug

SEQ ID NO: 7883 - RNA, 19 nt, Artificial Sequence
  Description of Artificial Sequence: Synthetic oligonucleotide
ccuguggcucccucugccu

SEQ ID NO: 7884 - RNA, 19 nt, Artificial Sequence
  Description of Artificial Sequence: Synthetic oligonucleotide
accuguggcucccucugcc

SEQ ID NO: 7885 - RNA, 19 nt, Artificial Sequence
  Description of Artificial Sequence: Synthetic oligonucleotide
gaccuguggcucccucugc

SEQ ID NO: 7886 - RNA, 19 nt, Artificial Sequence
  Description of Artificial Sequence: Synthetic oligonucleotide
ggaccuguggcucccucug

SEQ ID NO: 7887 - RNA, 19 nt, Artificial Sequence
  Description of Artificial Sequence: Synthetic oligonucleotide
gggaccuguggcucccucu

SEQ ID NO: 7888 - RNA, 19 nt, Artificial Sequence
  Description of Artificial Sequence: Synthetic oligonucleotide
agggaccuguggcucccuc

SEQ ID NO: 7889 - RNA, 19 nt, Artificial Sequence
  Description of Artificial Sequence: Synthetic oligonucleotide
uagggaccuguggcucccu

SEQ ID NO: 7890 - RNA, 19 nt, Artificial Sequence
  Description of Artificial Sequence: Synthetic oligonucleotide
cuagggaccuguggcuccc

SEQ ID NO: 7891 - RNA, 19 nt, Artificial Sequence
  Description of Artificial Sequence: Synthetic oligonucleotide
ccuagggaccuguggcucc

SEQ ID NO: 7892 - RNA, 19 nt, Artificial Sequence
  Description of Artificial Sequence: Synthetic oligonucleotide
gccuagggaccuguggcuc

SEQ ID NO: 7893 - RNA, 19 nt, Artificial Sequence
  Description of Artificial Sequence: Synthetic oligonucleotide
ggccuagggaccuguggcu

SEQ ID NO: 7894 - RNA, 19 nt, Artificial Sequence
  Description of Artificial Sequence: Synthetic oligonucleotide
aggccuagggaccuguggc

SEQ ID NO: 7895 - RNA, 19 nt, Artificial Sequence
  Description of Artificial Sequence: Synthetic oligonucleotide
caggccuagggaccugugg

SEQ ID NO: 7896 - RNA, 19 nt, Artificial Sequence
  Description of Artificial Sequence: Synthetic oligonucleotide
ccaggccuagggaccugug

SEQ ID NO: 7897 - RNA, 19 nt, Artificial Sequence
  Description of Artificial Sequence: Synthetic oligonucleotide
gccaggccuagggaccugu

SEQ ID NO: 7898 - RNA, 19 nt, Artificial Sequence
  Description of Artificial Sequence: Synthetic oligonucleotide
ggccaggccuagggaccug

SEQ ID NO: 7899 - RNA, 19 nt, Artificial Sequence
  Description of Artificial Sequence: Synthetic oligonucleotide
aggccaggccuagggaccu

SEQ ID NO: 7900 - RNA, 19 nt, Artificial Sequence
  Description of Artificial Sequence: Synthetic oligonucleotide
uaggccaggccuagggacc

SEQ ID NO: 7901 - RNA, 19 nt, Artificial Sequence
  Description of Artificial Sequence: Synthetic oligonucleotide
auaggccaggccuagggac

SEQ ID NO: 7902 - RNA, 19 nt, Artificial Sequence
  Description of Artificial Sequence: Synthetic oligonucleotide
gauaggccaggccuaggga

SEQ ID NO: 7903 - RNA, 19 nt, Artificial Sequence
  Description of Artificial Sequence: Synthetic oligonucleotide
cgauaggccaggccuaggg

SEQ ID NO: 7904 - RNA, 19 nt, Artificial Sequence
  Description of Artificial Sequence: Synthetic oligonucleotide
ccgauaggccaggccuagg

SEQ ID NO: 7905 - RNA, 19 nt, Artificial Sequence
  Description of Artificial Sequence: Synthetic oligonucleotide
uccgauaggccaggccuag

SEQ ID NO: 7906 - RNA, 19 nt, Artificial Sequence
  Description of Artificial Sequence: Synthetic oligonucleotide
cuccgauaggccaggccua

SEQ ID NO: 7907 - RNA, 19 nt, Artificial Sequence
  Description of Artificial Sequence: Synthetic oligonucleotide
ccuccgauaggccaggccu

SEQ ID NO: 7908 - RNA, 19 nt, Artificial Sequence
  Description of Artificial Sequence: Synthetic oligonucleotide
gccuccgauaggccaggcc

SEQ ID NO: 7909 - RNA, 19 nt, Artificial Sequence
  Description of Artificial Sequence: Synthetic oligonucleotide
cgccuccgauaggccaggc

SEQ ID NO: 7910 - RNA, 19 nt, Artificial Sequence
  Description of Artificial Sequence: Synthetic oligonucleotide
gcgccuccgauaggccagg

SEQ ID NO: 7911 - RNA, 19 nt, Artificial Sequence
  Description of Artificial Sequence: Synthetic oligonucleotide
agcgccuccgauaggccag

SEQ ID NO: 7912 - RNA, 19 nt, Artificial Sequence
  Description of Artificial Sequence: Synthetic oligonucleotide
aagcgccuccgauaggcca

SEQ ID NO: 7913 - RNA, 19 nt, Artificial Sequence
  Description of Artificial Sequence: Synthetic oligonucleotide
aaagcgccuccgauaggcc

SEQ ID NO: 7914 - RNA, 19 nt, Artificial Sequence
  Description of Artificial Sequence: Synthetic oligonucleotide
gaaagcgccuccgauaggc

SEQ ID NO: 7915 - RNA, 19 nt, Artificial Sequence
  Description of Artificial Sequence: Synthetic oligonucleotide
ggaaagcgccuccgauagg

SEQ ID NO: 7916 - RNA, 19 nt, Artificial Sequence
  Description of Artificial Sequence: Synthetic oligonucleotide
gggaaagcgccuccgauag

SEQ ID NO: 7917 - RNA, 19 nt, Artificial Sequence
  Description of Artificial Sequence: Synthetic oligonucleotide
agggaaagcgccuccgaua

SEQ ID NO: 7918 - RNA, 19 nt, Artificial Sequence
  Description of Artificial Sequence: Synthetic oligonucleotide
cagggaaagcgccuccgau

SEQ ID NO: 7919 - RNA, 19 nt, Artificial Sequence
  Description of Artificial Sequence: Synthetic oligonucleotide
gcagggaaagcgccuccga

SEQ ID NO: 7920 - RNA, 19 nt, Artificial Sequence
  Description of Artificial Sequence: Synthetic oligonucleotide
agcagggaaagcgccuccg

SEQ ID NO: 7921 - RNA, 19 nt, Artificial Sequence
  Description of Artificial Sequence: Synthetic oligonucleotide
gagcagggaaagcgccucc

SEQ ID NO: 7922 - RNA, 19 nt, Artificial Sequence
  Description of Artificial Sequence: Synthetic oligonucleotide
ggagcagggaaagcgccuc

SEQ ID NO: 7923 - RNA, 19 nt, Artificial Sequence
  Description of Artificial Sequence: Synthetic oligonucleotide
aggagcagggaaagcgccu

SEQ ID NO: 7924 - RNA, 19 nt, Artificial Sequence
  Description of Artificial Sequence: Synthetic oligonucleotide
caggagcagggaaagcgcc

SEQ ID NO: 7925 - RNA, 19 nt, Artificial Sequence
  Description of Artificial Sequence: Synthetic oligonucleotide
acaggagcagggaaagcgc

SEQ ID NO: 7926 - RNA, 19 nt, Artificial Sequence
  Description of Artificial Sequence: Synthetic oligonucleotide
aacaggagcagggaaagcg

SEQ ID NO: 7927 - RNA, 19 nt, Artificial Sequence
  Description of Artificial Sequence: Synthetic oligonucleotide
gaacaggagcagggaaagc

SEQ ID NO: 7928 - RNA, 19 nt, Artificial Sequence
  Description of Artificial Sequence: Synthetic oligonucleotide
cgaacaggagcagggaaag

SEQ ID NO: 7929 - RNA, 19 nt, Artificial Sequence
  Description of Artificial Sequence: Synthetic oligonucleotide
gcgaacaggagcagggaaa

SEQ ID NO: 7930 - RNA, 19 nt, Artificial Sequence
  Description of Artificial Sequence: Synthetic oligonucleotide
ggcgaacaggagcagggaa

SEQ ID NO: 7931 - RNA, 19 nt, Artificial Sequence
  Description of Artificial Sequence: Synthetic oligonucleotide
cggcgaacaggagcaggga

SEQ ID NO: 7932 - RNA, 19 nt, Artificial Sequence
  Description of Artificial Sequence: Synthetic oligonucleotide
acggcgaacaggagcaggg

SEQ ID NO: 7933 - RNA, 19 nt, Artificial Sequence
  Description of Artificial Sequence: Synthetic oligonucleotide
aacggcgaacaggagcagg

SEQ ID NO: 7934 - RNA, 19 nt, Artificial Sequence
  Description of Artificial Sequence: Synthetic oligonucleotide
caacggcgaacaggagcag

SEQ ID NO: 7935 - RNA, 19 nt, Artificial Sequence
  Description of Artificial Sequence: Synthetic oligonucleotide
acaacggcgaacaggagca

SEQ ID NO: 7936 - RNA, 19 nt, Artificial Sequence
  Description of Artificial Sequence: Synthetic oligonucleotide
aacaacggcgaacaggagc

SEQ ID NO: 7937 - RNA, 19 nt, Artificial Sequence
  Description of Artificial Sequence: Synthetic oligonucleotide
gaacaacggcgaacaggag

SEQ ID NO: 7938 - RNA, 19 nt, Artificial Sequence
  Description of Artificial Sequence: Synthetic oligonucleotide
agaacaacggcgaacagga

SEQ ID NO: 7939 - RNA, 19 nt, Artificial Sequence
  Description of Artificial Sequence: Synthetic oligonucleotide
cagaacaacggcgaacagg

SEQ ID NO: 7940 - RNA, 19 nt, Artificial Sequence
  Description of Artificial Sequence: Synthetic oligonucleotide
acagaacaacggcgaacag

SEQ ID NO: 7941 - RNA, 19 nt, Artificial Sequence
  Description of Artificial Sequence: Synthetic oligonucleotide
gacagaacaacggcgaaca

SEQ ID NO: 7942 - RNA, 19 nt, Artificial Sequence
  Description of Artificial Sequence: Synthetic oligonucleotide
agacagaacaacggcgaac

SEQ ID NO: 7943 - RNA, 19 nt, Artificial Sequence
  Description of Artificial Sequence: Synthetic oligonucleotide
gagacagaacaacggcgaa

SEQ ID NO: 7944 - RNA, 19 nt, Artificial Sequence
  Description of Artificial Sequence: Synthetic oligonucleotide
cgagacagaacaacggcga

SEQ ID NO: 7945 - RNA, 19 nt, Artificial Sequence
  Description of Artificial Sequence: Synthetic oligonucleotide
acgagacagaacaacggcg

SEQ ID NO: 7946 - RNA, 19 nt, Artificial Sequence
  Description of Artificial Sequence: Synthetic oligonucleotide
cacgagacagaacaacggc

SEQ ID NO: 7947 - RNA, 19 nt, Artificial Sequence
  Description of Artificial Sequence: Synthetic oligonucleotide
gcacgagacagaacaacgg

SEQ ID NO: 7948 - RNA, 19 nt, Artificial Sequence
  Description of Artificial Sequence: Synthetic oligonucleotide
ggcacgagacagaacaacg

SEQ ID NO: 7949 - RNA, 19 nt, Artificial Sequence
  Description of Artificial Sequence: Synthetic oligonucleotide
cggcacgagacagaacaac

SEQ ID NO: 7950 - RNA, 19 nt, Artificial Sequence
  Description of Artificial Sequence: Synthetic oligonucleotide
gcggcacgagacagaacaa

SEQ ID NO: 7951 - RNA, 19 nt, Artificial Sequence
  Description of Artificial Sequence: Synthetic oligonucleotide
ggcggcacgagacagaaca

SEQ ID NO: 7952 - RNA, 19 nt, Artificial Sequence
  Description of Artificial Sequence: Synthetic oligonucleotide
cggcggcacgagacagaac

SEQ ID NO: 7953 - RNA, 19 nt, Artificial Sequence
  Description of Artificial Sequence: Synthetic oligonucleotide
gcggcggcacgagacagaa

SEQ ID NO: 7954 - RNA, 19 nt, Artificial Sequence
  Description of Artificial Sequence: Synthetic oligonucleotide
ggcggcggcacgagacaga

SEQ ID NO: 7955 - RNA, 19 nt, Artificial Sequence
  Description of Artificial Sequence: Synthetic oligonucleotide
gggcggcggcacgagacag

SEQ ID NO: 7956 - RNA, 19 nt, Artificial Sequence
  Description of Artificial Sequence: Synthetic oligonucleotide
agggcggcggcacgagaca

SEQ ID NO: 7957 - RNA, 19 nt, Artificial Sequence
  Description of Artificial Sequence: Synthetic oligonucleotide
cagggcggcggcacgagac

SEQ ID NO: 7958 - RNA, 19 nt, Artificial Sequence
  Description of Artificial Sequence: Synthetic oligonucleotide
ccagggcggcggcacgaga

SEQ ID NO: 7959 - RNA, 19 nt, Artificial Sequence
  Description of Artificial Sequence: Synthetic oligonucleotide
cccagggcggcggcacgag

SEQ ID NO: 7960 - RNA, 19 nt, Artificial Sequence
  Description of Artificial Sequence: Synthetic oligonucleotide
gcccagggcggcggcacga

SEQ ID NO: 7961 - RNA, 19 nt, Artificial Sequence
  Description of Artificial Sequence: Synthetic oligonucleotide
agcccagggcggcggcacg

SEQ ID NO: 7962 - RNA, 19 nt, Artificial Sequence
  Description of Artificial Sequence: Synthetic oligonucleotide
cagcccagggcggcggcac

SEQ ID NO: 7963 - RNA, 19 nt, Artificial Sequence
  Description of Artificial Sequence: Synthetic oligonucleotide
gcagcccagggcggcggca

SEQ ID NO: 7964 - RNA, 19 nt, Artificial Sequence
  Description of Artificial Sequence: Synthetic oligonucleotide
ugcagcccagggcggcggc

SEQ ID NO: 7965 - RNA, 19 nt, Artificial Sequence
  Description of Artificial Sequence: Synthetic oligonucleotide
augcagcccagggcggcgg

SEQ ID NO: 7966 - RNA, 19 nt, Artificial Sequence
  Description of Artificial Sequence: Synthetic oligonucleotide
aaugcagcccagggcggcg

SEQ ID NO: 7967 - RNA, 19 nt, Artificial Sequence
  Description of Artificial Sequence: Synthetic oligonucleotide
caaugcagcccagggcggc

SEQ ID NO: 7968 - RNA, 19 nt, Artificial Sequence
  Description of Artificial Sequence: Synthetic oligonucleotide
ccaaugcagcccagggcgg

SEQ ID NO: 7969 - RNA, 19 nt, Artificial Sequence
  Description of Artificial Sequence: Synthetic oligonucleotide
cccaaugcagcccagggcg

SEQ ID NO: 7970 - RNA, 19 nt, Artificial Sequence
  Description of Artificial Sequence: Synthetic oligonucleotide
acccaaugcagcccagggc

SEQ ID NO: 7971 - RNA, 19 nt, Artificial Sequence
  Description of Artificial Sequence: Synthetic oligonucleotide
aacccaaugcagcccaggg

SEQ ID NO: 7972 - RNA, 19 nt, Artificial Sequence
  Description of Artificial Sequence: Synthetic oligonucleotide
caacccaaugcagcccagg

SEQ ID NO: 7973 - RNA, 19 nt, Artificial Sequence
  Description of Artificial Sequence: Synthetic oligonucleotide
ccaacccaaugcagcccag

SEQ ID NO: 7974 - RNA, 19 nt, Artificial Sequence
  Description of Artificial Sequence: Synthetic oligonucleotide
accaacccaaugcagccca

SEQ ID NO: 7975 - RNA, 19 nt, Artificial Sequence
  Description of Artificial Sequence: Synthetic oligonucleotide
caccaacccaaugcagccc

SEQ ID NO: 7976 - RNA, 19 nt, Artificial Sequence
  Description of Artificial Sequence: Synthetic oligonucleotide
ccaccaacccaaugcagcc

SEQ ID NO: 7977 - RNA, 19 nt, Artificial Sequence
  Description of Artificial Sequence: Synthetic oligonucleotide
gccaccaacccaaugcagc

SEQ ID NO: 7978 - RNA, 19 nt, Artificial Sequence
  Description of Artificial Sequence: Synthetic oligonucleotide
ggccaccaacccaaugcag

SEQ ID NO: 7979 - RNA, 19 nt, Artificial Sequence
  Description of Artificial Sequence: Synthetic oligonucleotide
gggccaccaacccaaugca

SEQ ID NO: 7980 - RNA, 19 nt, Artificial Sequence
  Description of Artificial Sequence: Synthetic oligonucleotide
ugggccaccaacccaaugc

SEQ ID NO: 7981 - RNA, 19 nt, Artificial Sequence
  Description of Artificial Sequence: Synthetic oligonucleotide
gugggccaccaacccaaug

SEQ ID NO: 7982 - RNA, 19 nt, Artificial Sequence
  Description of Artificial Sequence: Synthetic oligonucleotide
cgugggccaccaacccaau

SEQ ID NO: 7983 - RNA, 19 nt, Artificial Sequence
  Description of Artificial Sequence: Synthetic oligonucleotide
gcgugggccaccaacccaa

SEQ ID NO: 7984 - RNA, 19 nt, Artificial Sequence
  Description of Artificial Sequence: Synthetic oligonucleotide
ggcgugggccaccaaccca

SEQ ID NO: 7985 - RNA, 19 nt, Artificial Sequence
  Description of Artificial Sequence: Synthetic oligonucleotide
cggcgugggccaccaaccc

SEQ ID NO: 7986 - RNA, 19 nt, Artificial Sequence
  Description of Artificial Sequence: Synthetic oligonucleotide
ccggcgugggccaccaacc

SEQ ID NO: 7987 - RNA, 19 nt, Artificial Sequence
  Description of Artificial Sequence: Synthetic oligonucleotide
gccggcgugggccaccaac

SEQ ID NO: 7988 - RNA, 19 nt, Artificial Sequence
  Description of Artificial Sequence: Synthetic oligonucleotide
ggccggcgugggccaccaa

SEQ ID NO: 7989 - RNA, 19 nt, Artificial Sequence
  Description of Artificial Sequence: Synthetic oligonucleotide
uggccggcgugggccacca

SEQ ID NO: 7990 - RNA, 19 nt, Artificial Sequence
  Description of Artificial Sequence: Synthetic oligonucleotide
uuggccggcgugggccacc

SEQ ID NO: 7991 - RNA, 19 nt, Artificial Sequence
  Description of Artificial Sequence: Synthetic oligonucleotide
guuggccggcgugggccac

SEQ ID NO: 7992 - RNA, 19 nt, Artificial Sequence
  Description of Artificial Sequence: Synthetic oligonucleotide
aguuggccggcgugggcca

SEQ ID NO: 7993 - RNA, 19 nt, Artificial Sequence
  Description of Artificial Sequence: Synthetic oligonucleotide
gaguuggccggcgugggcc

SEQ ID NO: 7994 - RNA, 19 nt, Artificial Sequence
  Description of Artificial Sequence: Synthetic oligonucleotide
ugaguuggccggcgugggc

SEQ ID NO: 7995 - RNA, 19 nt, Artificial Sequence
  Description of Artificial Sequence: Synthetic oligonucleotide
gugaguuggccggcguggg

SEQ ID NO: 7996 - RNA, 19 nt, Artificial Sequence
  Description of Artificial Sequence: Synthetic oligonucleotide
ggugaguuggccggcgugg

SEQ ID NO: 7997 - RNA, 19 nt, Artificial Sequence
  Description of Artificial Sequence: Synthetic oligonucleotide
cggugaguuggccggcgug

SEQ ID NO: 7998 - RNA, 19 nt, Artificial Sequence
  Description of Artificial Sequence: Synthetic oligonucleotide
gcggugaguuggccggcgu

SEQ ID NO: 7999 - RNA, 19 nt, Artificial Sequence
  Description of Artificial Sequence: Synthetic oligonucleotide
ugcggugaguuggccggcg

SEQ ID NO: 8000 - RNA, 19 nt, Artificial Sequence
  Description of Artificial Sequence: Synthetic oligonucleotide
cugcggugaguuggccggc

SEQ ID NO: 8001 - RNA, 19 nt, Artificial Sequence
  Description of Artificial Sequence: Synthetic oligonucleotide
acugcggugaguuggccgg

SEQ ID NO: 8002 - RNA, 19 nt, Artificial Sequence
  Description of Artificial Sequence: Synthetic oligonucleotide
gacugcggugaguuggccg

SEQ ID NO: 8003 - RNA, 19 nt, Artificial Sequence
  Description of Artificial Sequence: Synthetic oligonucleotide
agacugcggugaguuggcc

SEQ ID NO: 8004 - RNA, 19 nt, Artificial Sequence
  Description of Artificial Sequence: Synthetic oligonucleotide
cagacugcggugaguuggc

SEQ ID NO: 8005 - RNA, 19 nt, Artificial Sequence
  Description of Artificial Sequence: Synthetic oligonucleotide
ccagacugcggugaguugg

SEQ ID NO: 8006 - RNA, 19 nt, Artificial Sequence
  Description of Artificial Sequence: Synthetic oligonucleotide
gccagacugcggugaguug

SEQ ID NO: 8007 - RNA, 19 nt, Artificial Sequence
  Description of Artificial Sequence: Synthetic oligonucleotide
cgccagacugcggugaguu

SEQ ID NO: 8008 - RNA, 19 nt, Artificial Sequence
  Description of Artificial Sequence: Synthetic oligonucleotide
gcgccagacugcggugagu

SEQ ID NO: 8009 - RNA, 19 nt, Artificial Sequence
  Description of Artificial Sequence: Synthetic oligonucleotide
ggcgccagacugcggugag

SEQ ID NO: 8010 - RNA, 19 nt, Artificial Sequence
  Description of Artificial Sequence: Synthetic oligonucleotide
cggcgccagacugcgguga

SEQ ID NO: 8011 - RNA, 19 nt, Artificial Sequence
  Description of Artificial Sequence: Synthetic oligonucleotide
gcggcgccagacugcggug

SEQ ID NO: 8012 - RNA, 19 nt, Artificial Sequence
  Description of Artificial Sequence: Synthetic oligonucleotide
ggcggcgccagacugcggu

SEQ ID NO: 8013 - RNA, 19 nt, Artificial Sequence
  Description of Artificial Sequence: Synthetic oligonucleotide
gggcggcgccagacugcgg

SEQ ID NO: 8014 - RNA, 19 nt, Artificial Sequence
  Description of Artificial Sequence: Synthetic oligonucleotide
ugggcggcgccagacugcg

SEQ ID NO: 8015 - RNA, 19 nt, Artificial Sequence
  Description of Artificial Sequence: Synthetic oligonucleotide
cugggcggcgccagacugc

SEQ ID NO: 8016 - RNA, 19 nt, Artificial Sequence
  Description of Artificial Sequence: Synthetic oligonucleotide
ccugggcggcgccagacug

SEQ ID NO: 8017 - RNA, 19 nt, Artificial Sequence
  Description of Artificial Sequence: Synthetic oligonucleotide
uccugggcggcgccagacu

SEQ ID NO: 8018 - RNA, 19 nt, Artificial Sequence
  Description of Artificial Sequence: Synthetic oligonucleotide
cuccugggcggcgccagac

SEQ ID NO: 8019 - RNA, 19 nt, Artificial Sequence
  Description of Artificial Sequence: Synthetic oligonucleotide
gcuccugggcggcgccaga

SEQ ID NO: 8020 - RNA, 19 nt, Artificial Sequence
  Description of Artificial Sequence: Synthetic oligonucleotide
ggcuccugggcggcgccag

SEQ ID NO: 8021 - RNA, 19 nt, Artificial Sequence
  Description of Artificial Sequence: Synthetic oligonucleotide
cggcuccugggcggcgcca

SEQ ID NO: 8022 - RNA, 19 nt, Artificial Sequence
  Description of Artificial Sequence: Synthetic oligonucleotide
gcggcuccugggcggcgcc

SEQ ID NO: 8023 - RNA, 19 nt, Artificial Sequence
  Description of Artificial Sequence: Synthetic oligonucleotide
ggcggcuccugggcggcgc

SEQ ID NO: 8024 - RNA, 19 nt, Artificial Sequence
  Description of Artificial Sequence: Synthetic oligonucleotide
gggcggcuccugggcggcg

SEQ ID NO: 8025 - RNA, 19 nt, Artificial Sequence
  Description of Artificial Sequence: Synthetic oligonucleotide
cgggcggcuccugggcggc

SEQ ID NO: 8026 - RNA, 19 nt, Artificial Sequence
  Description of Artificial Sequence: Synthetic oligonucleotide
gcgggcggcuccugggcgg

SEQ ID NO: 8027 - RNA, 19 nt, Artificial Sequence
  Description of Artificial Sequence: Synthetic oligonucleotide
cgcgggcggcuccugggcg

SEQ ID NO: 8028 - RNA, 19 nt, Artificial Sequence
  Description of Artificial Sequence: Synthetic oligonucleotide
gcgcgggcggcuccugggc

SEQ ID NO: 8029 - RNA, 19 nt, Artificial Sequence
  Description of Artificial Sequence: Synthetic oligonucleotide
agcgcgggcggcuccuggg

SEQ ID NO: 8030 - RNA, 19 nt, Artificial Sequence
  Description of Artificial Sequence: Synthetic oligonucleotide
gagcgcgggcggcuccugg

SEQ ID NO: 8031 - RNA, 19 nt, Artificial Sequence
  Description of Artificial Sequence: Synthetic oligonucleotide
ggagcgcgggcggcuccug

SEQ ID NO: 8032 - RNA, 19 nt, Artificial Sequence
  Description of Artificial Sequence: Synthetic oligonucleotide
gggagcgcgggcggcuccu

SEQ ID NO: 8033 - RNA, 19 nt, Artificial Sequence
  Description of Artificial Sequence: Synthetic oligonucleotide
agggagcgcgggcggcucc

SEQ ID NO: 8034 - RNA, 19 nt, Artificial Sequence
  Description of Artificial Sequence: Synthetic oligonucleotide
cagggagcgcgggcggcuc

SEQ ID NO: 8035 - RNA, 19 nt, Artificial Sequence
  Description of Artificial Sequence: Synthetic oligonucleotide
ucagggagcgcgggcggcu

SEQ ID NO: 8036 - RNA, 19 nt, Artificial Sequence
  Description of Artificial Sequence: Synthetic oligonucleotide
uucagggagcgcgggcggc

SEQ ID NO: 8037 - RNA, 19 nt, Artificial Sequence
  Description of Artificial Sequence: Synthetic oligonucleotide
guucagggagcgcgggcgg

SEQ ID NO: 8038 - RNA, 19 nt, Artificial Sequence
  Description of Artificial Sequence: Synthetic oligonucleotide
gguucagggagcgcgggcg

SEQ ID NO: 8039 - RNA, 19 nt, Artificial Sequence
  Description of Artificial Sequence: Synthetic oligonucleotide
ggguucagggagcgcgggc

SEQ ID NO: 8040 - RNA, 19 nt, Artificial Sequence
  Description of Artificial Sequence: Synthetic oligonucleotide
aggguucagggagcgcggg

SEQ ID NO: 8041 - RNA, 19 nt, Artificial Sequence
  Description of Artificial Sequence: Synthetic oligonucleotide
uaggguucagggagcgcgg

SEQ ID NO: 8042 - RNA, 19 nt, Artificial Sequence
  Description of Artificial Sequence: Synthetic oligonucleotide
cuaggguucagggagcgcg

SEQ ID NO: 8043 - RNA, 19 nt, Artificial Sequence
  Description of Artificial Sequence: Synthetic oligonucleotide
ucuaggguucagggagcgc

SEQ ID NO: 8044 - RNA, 19 nt, Artificial Sequence
  Description of Artificial Sequence: Synthetic oligonucleotide
uucuaggguucagggagcg

SEQ ID NO: 8045 - RNA, 19 nt, Artificial Sequence
  Description of Artificial Sequence: Synthetic oligonucleotide
guucuaggguucagggagc

SEQ ID NO: 8046 - RNA, 19 nt, Artificial Sequence
  Description of Artificial Sequence: Synthetic oligonucleotide
aguucuaggguucagggag

SEQ ID NO: 8047 - RNA, 19 nt, Artificial Sequence
  Description of Artificial Sequence: Synthetic oligonucleotide
caguucuaggguucaggga

SEQ ID NO: 8048 - RNA, 19 nt, Artificial Sequence
  Description of Artificial Sequence: Synthetic oligonucleotide
acaguucuaggguucaggg

SEQ ID NO: 8049 - RNA, 19 nt, Artificial Sequence
  Description of Artificial Sequence: Synthetic oligonucleotide
gacaguucuaggguucagg

SEQ ID NO: 8050 - RNA, 19 nt, Artificial Sequence
  Description of Artificial Sequence: Synthetic oligonucleotide
agacaguucuaggguucag

SEQ ID NO: 8051 - RNA, 19 nt, Artificial Sequence
  Description of Artificial Sequence: Synthetic oligonucleotide
aagacaguucuaggguuca

SEQ ID NO: 8052 - RNA, 19 nt, Artificial Sequence
  Description of Artificial Sequence: Synthetic oligonucleotide
gaagacaguucuaggguuc

SEQ ID NO: 8053 - RNA, 19 nt, Artificial Sequence
  Description of Artificial Sequence: Synthetic oligonucleotide
cgaagacaguucuaggguu

SEQ ID NO: 8054 - RNA, 19 nt, Artificial Sequence
  Description of Artificial Sequence: Synthetic oligonucleotide
ucgaagacaguucuagggu

SEQ ID NO: 8055 - RNA, 19 nt, Artificial Sequence
  Description of Artificial Sequence: Synthetic oligonucleotide
gucgaagacaguucuaggg

SEQ ID NO: 8056 - RNA, 19 nt, Artificial Sequence
  Description of Artificial Sequence: Synthetic oligonucleotide
agucgaagacaguucuagg

SEQ ID NO: 8057 - RNA, 19 nt, Artificial Sequence
  Description of Artificial Sequence: Synthetic oligonucleotide
gagucgaagacaguucuag

SEQ ID NO: 8058 - RNA, 19 nt, Artificial Sequence
  Description of Artificial Sequence: Synthetic oligonucleotide
ggagucgaagacaguucua

SEQ ID NO: 8059 - RNA, 19 nt, Artificial Sequence
  Description of Artificial Sequence: Synthetic oligonucleotide
cggagucgaagacaguucu

SEQ ID NO: 8060 - RNA, 19 nt, Artificial Sequence
  Description of Artificial Sequence: Synthetic oligonucleotide
ccggagucgaagacaguuc

SEQ ID NO: 8061 - RNA, 19 nt, Artificial Sequence
  Description of Artificial Sequence: Synthetic oligonucleotide
cccggagucgaagacaguu

SEQ ID NO: 8062 - RNA, 19 nt, Artificial Sequence
  Description of Artificial Sequence: Synthetic oligonucleotide
ccccggagucgaagacagu

SEQ ID NO: 8063 - RNA, 19 nt, Artificial Sequence
  Description of Artificial Sequence: Synthetic oligonucleotide
gccccggagucgaagacag

SEQ ID NO: 8064 - RNA, 19 nt, Artificial Sequence
  Description of Artificial Sequence: Synthetic oligonucleotide
ggccccggagucgaagaca

SEQ ID NO: 8065 - RNA, 19 nt, Artificial Sequence
  Description of Artificial Sequence: Synthetic oligonucleotide
gggccccggagucgaagac

SEQ ID NO: 8066 - RNA, 19 nt, Artificial Sequence
  Description of Artificial Sequence: Synthetic oligonucleotide
ggggccccggagucgaaga

SEQ ID NO: 8067 - RNA, 19 nt, Artificial Sequence
  Description of Artificial Sequence: Synthetic oligonucleotide
cggggccccggagucgaag

SEQ ID NO: 8068 - RNA, 19 nt, Artificial Sequence
  Description of Artificial Sequence: Synthetic oligonucleotide
acggggccccggagucgaa

SEQ ID NO: 8069 - RNA, 19 nt, Artificial Sequence
  Description of Artificial Sequence: Synthetic oligonucleotide
aacggggccccggagucga

SEQ ID NO: 8070 - RNA, 19 nt, Artificial Sequence
  Description of Artificial Sequence: Synthetic oligonucleotide
caacggggccccggagucg

SEQ ID NO: 8071 - RNA, 19 nt, Artificial Sequence
  Description of Artificial Sequence: Synthetic oligonucleotide
ccaacggggccccggaguc

SEQ ID NO: 8072 - RNA, 19 nt, Artificial Sequence
  Description of Artificial Sequence: Synthetic oligonucleotide
uccaacggggccccggagu

SEQ ID NO: 8073 - RNA, 19 nt, Artificial Sequence
  Description of Artificial Sequence: Synthetic oligonucleotide
uuccaacggggccccggag

SEQ ID NO: 8074 - RNA, 19 nt, Artificial Sequence
  Description of Artificial Sequence: Synthetic oligonucleotide
cuuccaacggggccccgga

SEQ ID NO: 8075 - RNA, 19 nt, Artificial Sequence
  Description of Artificial Sequence: Synthetic oligonucleotide
ucuuccaacggggccccgg

SEQ ID NO: 8076 - RNA, 19 nt, Artificial Sequence
  Description of Artificial Sequence: Synthetic oligonucleotide
gucuuccaacggggccccg

SEQ ID NO: 8077 - RNA, 19 nt, Artificial Sequence
  Description of Artificial Sequence: Synthetic oligonucleotide
agucuuccaacggggcccc

SEQ ID NO: 8078 - RNA, 19 nt, Artificial Sequence
  Description of Artificial Sequence: Synthetic oligonucleotide
cagucuuccaacggggccc

SEQ ID NO: 8079 - RNA, 19 nt, Artificial Sequence
  Description of Artificial Sequence: Synthetic oligonucleotide
ucagucuuccaacggggcc

SEQ ID NO: 8080 - RNA, 19 nt, Artificial Sequence
  Description of Artificial Sequence: Synthetic oligonucleotide
cucagucuuccaacggggc

SEQ ID NO: 8081 - RNA, 19 nt, Artificial Sequence
  Description of Artificial Sequence: Synthetic oligonucleotide
acucagucuuccaacgggg

SEQ ID NO: 8082 - RNA, 19 nt, Artificial Sequence
  Description of Artificial Sequence: Synthetic oligonucleotide
cacucagucuuccaacggg

SEQ ID NO: 8083 - RNA, 19 nt, Artificial Sequence
  Description of Artificial Sequence: Synthetic oligonucleotide
gcacucagucuuccaacgg

SEQ ID NO: 8084 - RNA, 19 nt, Artificial Sequence
  Description of Artificial Sequence: Synthetic oligonucleotide
ggcacucagucuuccaacg

SEQ ID NO: 8085 - RNA, 19 nt, Artificial Sequence
  Description of Artificial Sequence: Synthetic oligonucleotide
gggcacucagucuuccaac

SEQ ID NO: 8086 - RNA, 19 nt, Artificial Sequence
  Description of Artificial Sequence: Synthetic oligonucleotide
cgggcacucagucuuccaa

SEQ ID NO: 8087 - RNA, 19 nt, Artificial Sequence
  Description of Artificial Sequence: Synthetic oligonucleotide
ccgggcacucagucuucca

SEQ ID NO: 8088 - RNA, 19 nt, Artificial Sequence
  Description of Artificial Sequence: Synthetic oligonucleotide
cccgggcacucagucuucc

SEQ ID NO: 8089 - RNA, 19 nt, Artificial Sequence
  Description of Artificial Sequence: Synthetic oligonucleotide
ccccgggcacucagucuuc

SEQ ID NO: 8090 - RNA, 19 nt, Artificial Sequence
  Description of Artificial Sequence: Synthetic oligonucleotide
gccccgggcacucagucuu

SEQ ID NO: 8091 - RNA, 19 nt, Artificial Sequence
  Description of Artificial Sequence: Synthetic oligonucleotide
ugccccgggcacucagucu

SEQ ID NO: 8092 - RNA, 19 nt, Artificial Sequence
  Description of Artificial Sequence: Synthetic oligonucleotide
gugccccgggcacucaguc

SEQ ID NO: 8093 - RNA, 19 nt, Artificial Sequence
  Description of Artificial Sequence: Synthetic oligonucleotide
cgugccccgggcacucagu

SEQ ID NO: 8094 - RNA, 19 nt, Artificial Sequence
  Description of Artificial Sequence: Synthetic oligonucleotide
ccgugccccgggcacucag

SEQ ID NO: 8095 - RNA, 19 nt, Artificial Sequence
  Description of Artificial Sequence: Synthetic oligonucleotide
gccgugccccgggcacuca

SEQ ID NO: 8096 - RNA, 19 nt, Artificial Sequence
  Description of Artificial Sequence: Synthetic oligonucleotide
ugccgugccccgggcacuc

SEQ ID NO: 8097 - RNA, 19 nt, Artificial Sequence
  Description of Artificial Sequence: Synthetic oligonucleotide
gugccgugccccgggcacu

SEQ ID NO: 8098 - RNA, 19 nt, Artificial Sequence
  Description of Artificial Sequence: Synthetic oligonucleotide
ugugccgugccccgggcac

SEQ ID NO: 8099 - RNA, 19 nt, Artificial Sequence
  Description of Artificial Sequence: Synthetic oligonucleotide
cugugccgugccccgggca

SEQ ID NO: 8100 - RNA, 19 nt, Artificial Sequence
  Description of Artificial Sequence: Synthetic oligonucleotide
ucugugccgugccccgggc

SEQ ID NO: 8101 - RNA, 19 nt, Artificial Sequence
  Description of Artificial Sequence: Synthetic oligonucleotide
uucugugccgugccccggg

SEQ ID NO: 8102 - RNA, 19 nt, Artificial Sequence
  Description of Artificial Sequence: Synthetic oligonucleotide
cuucugugccgugccccgg

SEQ ID NO: 8103 - RNA, 19 nt, Artificial Sequence
  Description of Artificial Sequence: Synthetic oligonucleotide
gcuucugugccgugccccg

SEQ ID NO: 8104 - RNA, 19 nt, Artificial Sequence
  Description of Artificial Sequence: Synthetic oligonucleotide
ggcuucugugccgugcccc

SEQ ID NO: 8105 - RNA, 19 nt, Artificial Sequence
  Description of Artificial Sequence: Synthetic oligonucleotide
cggcuucugugccgugccc

SEQ ID NO: 8106 - RNA, 19 nt, Artificial Sequence
  Description of Artificial Sequence: Synthetic oligonucleotide
gcggcuucugugccgugcc

SEQ ID NO: 8107 - RNA, 19 nt, Artificial Sequence
  Description of Artificial Sequence: Synthetic oligonucleotide
cgcggcuucugugccgugc

SEQ ID NO: 8108 - RNA, 19 nt, Artificial Sequence
  Description of Artificial Sequence: Synthetic oligonucleotide
gcgcggcuucugugccgug

SEQ ID NO: 8109 - RNA, 19 nt, Artificial Sequence
  Description of Artificial Sequence: Synthetic oligonucleotide
ggcgcggcuucugugccgu

SEQ ID NO: 8110 - RNA, 19 nt, Artificial Sequence
  Description of Artificial Sequence: Synthetic oligonucleotide
gggcgcggcuucugugccg

SEQ ID NO: 8111 - RNA, 19 nt, Artificial Sequence
  Description of Artificial Sequence: Synthetic oligonucleotide
ugggcgcggcuucugugcc

SEQ ID NO: 8112 - RNA, 19 nt, Artificial Sequence
  Description of Artificial Sequence: Synthetic oligonucleotide
gugggcgcggcuucugugc

SEQ ID NO: 8113 - RNA, 19 nt, Artificial Sequence
  Description of Artificial Sequence: Synthetic oligonucleotide
ggugggcgcggcuucugug

SEQ ID NO: 8114 - RNA, 19 nt, Artificial Sequence
  Description of Artificial Sequence: Synthetic oligonucleotide
cggugggcgcggcuucugu

SEQ ID NO: 8115 - RNA, 19 nt, Artificial Sequence
  Description of Artificial Sequence: Synthetic oligonucleotide
gcggugggcgcggcuucug

SEQ ID NO: 8116 - RNA, 19 nt, Artificial Sequence
  Description of Artificial Sequence: Synthetic oligonucleotide
ggcggugggcgcggcuucu

SEQ ID NO: 8117 - RNA, 19 nt, Artificial Sequence
  Description of Artificial Sequence: Synthetic oligonucleotide
aggcggugggcgcggcuuc

SEQ ID NO: 8118 - RNA, 19 nt, Artificial Sequence
  Description of Artificial Sequence: Synthetic oligonucleotide
caggcggugggcgcggcuu

SEQ ID NO: 8119 - RNA, 19 nt, Artificial Sequence
  Description of Artificial Sequence: Synthetic oligonucleotide
gcaggcggugggcgcggcu

SEQ ID NO: 8120 - RNA, 19 nt, Artificial Sequence
  Description of Artificial Sequence: Synthetic oligonucleotide
ggcaggcggugggcgcggc

SEQ ID NO: 8121 - RNA, 19 nt, Artificial Sequence
  Description of Artificial Sequence: Synthetic oligonucleotide
uggcaggcggugggcgcgg

SEQ ID NO: 8122 - RNA, 19 nt, Artificial Sequence
  Description of Artificial Sequence: Synthetic oligonucleotide
cuggcaggcggugggcgcg

SEQ ID NO: 8123 - RNA, 19 nt, Artificial Sequence
  Description of Artificial Sequence: Synthetic oligonucleotide
acuggcaggcggugggcgc

SEQ ID NO: 8124 - RNA, 19 nt, Artificial Sequence
  Description of Artificial Sequence: Synthetic oligonucleotide
aacuggcaggcggugggcg

SEQ ID NO: 8125 - RNA, 19 nt, Artificial Sequence
  Description of Artificial Sequence: Synthetic oligonucleotide
gaacuggcaggcggugggc

SEQ ID NO: 8126 - RNA, 19 nt, Artificial Sequence
  Description of Artificial Sequence: Synthetic oligonucleotide
ugaacuggcaggcgguggg

SEQ ID NO: 8127 - RNA, 19 nt, Artificial Sequence
  Description of Artificial Sequence: Synthetic oligonucleotide
gugaacuggcaggcggugg

SEQ ID NO: 8128 - RNA, 19 nt, Artificial Sequence
  Description of Artificial Sequence: Synthetic oligonucleotide
ugugaacuggcaggcggug

SEQ ID NO: 8129 - RNA, 19 nt, Artificial Sequence
  Description of Artificial Sequence: Synthetic oligonucleotide
uugugaacuggcaggcggu

SEQ ID NO: 8130 - RNA, 19 nt, Artificial Sequence
  Description of Artificial Sequence: Synthetic oligonucleotide
guugugaacuggcaggcgg

SEQ ID NO: 8131 - RNA, 19 nt, Artificial Sequence
  Description of Artificial Sequence: Synthetic oligonucleotide
gguugugaacuggcaggcg

SEQ ID NO: 8132 - RNA, 19 nt, Artificial Sequence
  Description of Artificial Sequence: Synthetic oligonucleotide
cgguugugaacuggcaggc

SEQ ID NO: 8133 - RNA, 19 nt, Artificial Sequence
  Description of Artificial Sequence: Synthetic oligonucleotide
gcgguugugaacuggcagg

SEQ ID NO: 8134 - RNA, 19 nt, Artificial Sequence
  Description of Artificial Sequence: Synthetic oligonucleotide
agcgguugugaacuggcag

SEQ ID NO: 8135 - RNA, 19 nt, Artificial Sequence
  Description of Artificial Sequence: Synthetic oligonucleotide
gagcgguugugaacuggca

SEQ ID NO: 8136 - RNA, 19 nt, Artificial Sequence
  Description of Artificial Sequence: Synthetic oligonucleotide
ggagcgguugugaacuggc

SEQ ID NO: 8137 - RNA, 19 nt, Artificial Sequence
  Description of Artificial Sequence: Synthetic oligonucleotide
cggagcgguugugaacugg

SEQ ID NO: 8138 - RNA, 19 nt, Artificial Sequence
  Description of Artificial Sequence: Synthetic oligonucleotide
ucggagcgguugugaacug

SEQ ID NO: 8139 - RNA, 19 nt, Artificial Sequence
  Description of Artificial Sequence: Synthetic oligonucleotide
cucggagcgguugugaacu

SEQ ID NO: 8140 - RNA, 19 nt, Artificial Sequence
  Description of Artificial Sequence: Synthetic oligonucleotide
gcucggagcgguugugaac

SEQ ID NO: 8141 - RNA, 19 nt, Artificial Sequence
  Description of Artificial Sequence: Synthetic oligonucleotide
cgcucggagcgguugugaa

SEQ ID NO: 8142 - RNA, 19 nt, Artificial Sequence
  Description of Artificial Sequence: Synthetic oligonucleotide
acgcucggagcgguuguga

SEQ ID NO: 8143 - RNA, 19 nt, Artificial Sequence
  Description of Artificial Sequence: Synthetic oligonucleotide
cacgcucggagcgguugug

SEQ ID NO: 8144 - RNA, 19 nt, Artificial Sequence
  Description of Artificial Sequence: Synthetic oligonucleotide
ccacgcucggagcgguugu

SEQ ID NO: 8145 - RNA, 19 nt, Artificial Sequence
  Description of Artificial Sequence: Synthetic oligonucleotide
cccacgcucggagcgguug

SEQ ID NO: 8146 - RNA, 19 nt, Artificial Sequence
  Description of Artificial Sequence: Synthetic oligonucleotide
acccacgcucggagcgguu

SEQ ID NO: 8147 - RNA, 19 nt, Artificial Sequence
  Description of Artificial Sequence: Synthetic oligonucleotide
gacccacgcucggagcggu

SEQ ID NO: 8148 - RNA, 19 nt, Artificial Sequence
  Description of Artificial Sequence: Synthetic oligonucleotide
agacccacgcucggagcgg

SEQ ID NO: 8149 - RNA, 19 nt, Artificial Sequence
  Description of Artificial Sequence: Synthetic oligonucleotide
gagacccacgcucggagcg

SEQ ID NO: 8150 - RNA, 19 nt, Artificial Sequence
  Description of Artificial Sequence: Synthetic oligonucleotide
ggagacccacgcucggagc

SEQ ID NO: 8151 - RNA, 19 nt, Artificial Sequence
  Description of Artificial Sequence: Synthetic oligonucleotide
cggagacccacgcucggag

SEQ ID NO: 8152 - RNA, 19 nt, Artificial Sequence
  Description of Artificial Sequence: Synthetic oligonucleotide
gcggagacccacgcucgga

SEQ ID NO: 8153 - RNA, 19 nt, Artificial Sequence
  Description of Artificial Sequence: Synthetic oligonucleotide
ggcggagacccacgcucgg

SEQ ID NO: 8154 - RNA, 19 nt, Artificial Sequence
  Description of Artificial Sequence: Synthetic oligonucleotide
gggcggagacccacgcucg

SEQ ID NO: 8155 - RNA, 19 nt, Artificial Sequence
  Description of Artificial Sequence: Synthetic oligonucleotide
ugggcggagacccacgcuc

SEQ ID NO: 8156 - RNA, 19 nt, Artificial Sequence
  Description of Artificial Sequence: Synthetic oligonucleotide
cugggcggagacccacgcu

SEQ ID NO: 8157 - RNA, 19 nt, Artificial Sequence
  Description of Artificial Sequence: Synthetic oligonucleotide
gcugggcggagacccacgc

SEQ ID NO: 8158 - RNA, 19 nt, Artificial Sequence
  Description of Artificial Sequence: Synthetic oligonucleotide
agcugggcggagacccacg

SEQ ID NO: 8159 - RNA, 19 nt, Artificial Sequence
  Description of Artificial Sequence: Synthetic oligonucleotide
gagcugggcggagacccac

SEQ ID NO: 8160 - RNA, 19 nt, Artificial Sequence
  Description of Artificial Sequence: Synthetic oligonucleotide
ggagcugggcggagaccca

SEQ ID NO: 8161 - RNA, 19 nt, Artificial Sequence
  Description of Artificial Sequence: Synthetic oligonucleotide
uggagcugggcggagaccc

SEQ ID NO: 8162 - RNA, 19 nt, Artificial Sequence
  Description of Artificial Sequence: Synthetic oligonucleotide
cuggagcugggcggagacc

SEQ ID NO: 8163 - RNA, 19 nt, Artificial Sequence
  Description of Artificial Sequence: Synthetic oligonucleotide
acuggagcugggcggagac

SEQ ID NO: 8164 - RNA, 19 nt, Artificial Sequence
  Description of Artificial Sequence: Synthetic oligonucleotide
gacuggagcugggcggaga

SEQ ID NO: 8165 - RNA, 19 nt, Artificial Sequence
  Description of Artificial Sequence: Synthetic oligonucleotide
ggacuggagcugggcggag

SEQ ID NO: 8166 - RNA, 19 nt, Artificial Sequence
  Description of Artificial Sequence: Synthetic oligonucleotide
aggacuggagcugggcgga

SEQ ID NO: 8167 - RNA, 19 nt, Artificial Sequence
  Description of Artificial Sequence: Synthetic oligonucleotide
caggacuggagcugggcgg

SEQ ID NO: 8168 - RNA, 19 nt, Artificial Sequence
  Description of Artificial Sequence: Synthetic oligonucleotide
acaggacuggagcugggcg

SEQ ID NO: 8169 - RNA, 19 nt, Artificial Sequence
  Description of Artificial Sequence: Synthetic oligonucleotide
cacaggacuggagcugggc

SEQ ID NO: 8170 - RNA, 19 nt, Artificial Sequence
  Description of Artificial Sequence: Synthetic oligonucleotide
ucacaggacuggagcuggg

SEQ ID NO: 8171 - RNA, 19 nt, Artificial Sequence
  Description of Artificial Sequence: Synthetic oligonucleotide
aucacaggacuggagcugg

SEQ ID NO: 8172 - RNA, 19 nt, Artificial Sequence
  Description of Artificial Sequence: Synthetic oligonucleotide
gaucacaggacuggagcug

SEQ ID NO: 8173 - RNA, 19 nt, Artificial Sequence
  Description of Artificial Sequence: Synthetic oligonucleotide
ggaucacaggacuggagcu

SEQ ID NO: 8174 - RNA, 19 nt, Artificial Sequence
  Description of Artificial Sequence: Synthetic oligonucleotide
cggaucacaggacuggagc

SEQ ID NO: 8175 - RNA, 19 nt, Artificial Sequence
  Description of Artificial Sequence: Synthetic oligonucleotide
ccggaucacaggacuggag

SEQ ID NO: 8176 - RNA, 19 nt, Artificial Sequence
  Description of Artificial Sequence: Synthetic oligonucleotide
cccggaucacaggacugga

SEQ ID NO: 8177 - RNA, 19 nt, Artificial Sequence
  Description of Artificial Sequence: Synthetic oligonucleotide
gcccggaucacaggacugg

SEQ ID NO: 8178 - RNA, 19 nt, Artificial Sequence
  Description of Artificial Sequence: Synthetic oligonucleotide
ggcccggaucacaggacug

SEQ ID NO: 8179 - RNA, 19 nt, Artificial Sequence
  Description of Artificial Sequence: Synthetic oligonucleotide
gggcccggaucacaggacu

SEQ ID NO: 8180 - RNA, 19 nt, Artificial Sequence
  Description of Artificial Sequence: Synthetic oligonucleotide
cgggcccggaucacaggac

SEQ ID NO: 8181 - RNA, 19 nt, Artificial Sequence
  Description of Artificial Sequence: Synthetic oligonucleotide
gcgggcccggaucacagga

SEQ ID NO: 8182 - RNA, 19 nt, Artificial Sequence
  Description of Artificial Sequence: Synthetic oligonucleotide
ggcgggcccggaucacagg

SEQ ID NO: 8183 - RNA, 19 nt, Artificial Sequence
  Description of Artificial Sequence: Synthetic oligonucleotide
gggcgggcccggaucacag

SEQ ID NO: 8184 - RNA, 19 nt, Artificial Sequence
  Description of Artificial Sequence: Synthetic oligonucleotide
ggggcgggcccggaucaca

SEQ ID NO: 8185 - RNA, 19 nt, Artificial Sequence
  Description of Artificial Sequence: Synthetic oligonucleotide
gggggcgggcccggaucac

SEQ ID NO: 8186 - RNA, 19 nt, Artificial Sequence
  Description of Artificial Sequence: Synthetic oligonucleotide
agggggcgggcccggauca

SEQ ID NO: 8187 - RNA, 19 nt, Artificial Sequence
  Description of Artificial Sequence: Synthetic oligonucleotide
uagggggcgggcccggauc

SEQ ID NO: 8188 - RNA, 19 nt, Artificial Sequence
  Description of Artificial Sequence: Synthetic oligonucleotide
cuagggggcgggcccggau

SEQ ID NO: 8189 - RNA, 19 nt, Artificial Sequence
  Description of Artificial Sequence: Synthetic oligonucleotide
gcuagggggcgggcccgga

SEQ ID NO: 8190 - RNA, 19 nt, Artificial Sequence
  Description of Artificial Sequence: Synthetic oligonucleotide
cgcuagggggcgggcccgg

SEQ ID NO: 8191 - RNA, 19 nt, Artificial Sequence
  Description of Artificial Sequence: Synthetic oligonucleotide
ccgcuagggggcgggcccg

SEQ ID NO: 8192 - RNA, 19 nt, Artificial Sequence
  Description of Artificial Sequence: Synthetic oligonucleotide
gccgcuagggggcgggccc

SEQ ID NO: 8193 - RNA, 19 nt, Artificial Sequence
  Description of Artificial Sequence: Synthetic oligonucleotide
ggccgcuagggggcgggcc

SEQ ID NO: 8194 - RNA, 19 nt, Artificial Sequence
  Description of Artificial Sequence: Synthetic oligonucleotide
cggccgcuagggggcgggc

SEQ ID NO: 8195 - RNA, 19 nt, Artificial Sequence
  Description of Artificial Sequence: Synthetic oligonucleotide
ccggccgcuagggggcggg

SEQ ID NO: 8196 - RNA, 19 nt, Artificial Sequence
  Description of Artificial Sequence: Synthetic oligonucleotide
cccggccgcuagggggcgg

SEQ ID NO: 8197 - RNA, 19 nt, Artificial Sequence
  Description of Artificial Sequence: Synthetic oligonucleotide
ccccggccgcuagggggcg

SEQ ID NO: 8198 - RNA, 19 nt, Artificial Sequence
  Description of Artificial Sequence: Synthetic oligonucleotide
uccccggccgcuagggggc

SEQ ID NO: 8199 - RNA, 19 nt, Artificial Sequence
  Description of Artificial Sequence: Synthetic oligonucleotide
cuccccggccgcuaggggg

SEQ ID NO: 8200 - RNA, 19 nt, Artificial Sequence
  Description of Artificial Sequence: Synthetic oligonucleotide
ccuccccggccgcuagggg

SEQ ID NO: 8201 - RNA, 19 nt, Artificial Sequence
  Description of Artificial Sequence: Synthetic oligonucleotide
cccuccccggccgcuaggg

SEQ ID NO: 8202 - RNA, 19 nt, Artificial Sequence
  Description of Artificial Sequence: Synthetic oligonucleotide
ucccuccccggccgcuagg

SEQ ID NO: 8203 - RNA, 19 nt, Artificial Sequence
  Description of Artificial Sequence: Synthetic oligonucleotide
cucccuccccggccgcuag

SEQ ID NO: 8204 - RNA, 19 nt, Artificial Sequence
  Description of Artificial Sequence: Synthetic oligonucleotide
ccucccuccccggccgcua

SEQ ID NO: 8205 - RNA, 19 nt, Artificial Sequence
  Description of Artificial Sequence: Synthetic oligonucleotide
cccucccuccccggccgcu

SEQ ID NO: 8206 - RNA, 19 nt, Artificial Sequence
  Description of Artificial Sequence: Synthetic oligonucleotide
ccccucccuccccggccgc

SEQ ID NO: 8207 - RNA, 19 nt, Artificial Sequence
  Description of Artificial Sequence: Synthetic oligonucleotide
gccccucccuccccggccg

SEQ ID NO: 8208 - RNA, 19 nt, Artificial Sequence
  Description of Artificial Sequence: Synthetic oligonucleotide
ggccccucccuccccggcc

SEQ ID NO: 8209 - RNA, 19 nt, Artificial Sequence
  Description of Artificial Sequence: Synthetic oligonucleotide
cggccccucccuccccggc

SEQ ID NO: 8210 - RNA, 19 nt, Artificial Sequence
  Description of Artificial Sequence: Synthetic oligonucleotide
ccggccccucccuccccgg

SEQ ID NO: 8211 - RNA, 19 nt, Artificial Sequence
  Description of Artificial Sequence: Synthetic oligonucleotide
cccggccccucccuccccg

SEQ ID NO: 8212 - RNA, 19 nt, Artificial Sequence
  Description of Artificial Sequence: Synthetic oligonucleotide
acccggccccucccucccc

SEQ ID NO: 8213 - RNA, 19 nt, Artificial Sequence
  Description of Artificial Sequence: Synthetic oligonucleotide
gacccggccccucccuccc

SEQ ID NO: 8214 - RNA, 19 nt, Artificial Sequence
  Description of Artificial Sequence: Synthetic oligonucleotide
ggacccggccccucccucc

SEQ ID NO: 8215 - RNA, 19 nt, Artificial Sequence
  Description of Artificial Sequence: Synthetic oligonucleotide
cggacccggccccucccuc

SEQ ID NO: 8216 - RNA, 19 nt, Artificial Sequence
  Description of Artificial Sequence: Synthetic oligonucleotide
gcggacccggccccucccu

SEQ ID NO: 8217 - RNA, 19 nt, Artificial Sequence
  Description of Artificial Sequence: Synthetic oligonucleotide
cgcggacccggccccuccc

SEQ ID NO: 8218 - RNA, 19 nt, Artificial Sequence
  Description of Artificial Sequence: Synthetic oligonucleotide
ccgcggacccggccccucc

SEQ ID NO: 8219 - RNA, 19 nt, Artificial Sequence
  Description of Artificial Sequence: Synthetic oligonucleotide
gccgcggacccggccccuc

SEQ ID NO: 8220 - RNA, 19 nt, Artificial Sequence
  Description of Artificial Sequence: Synthetic oligonucleotide
ggccgcggacccggccccu

SEQ ID NO: 8221 - RNA, 19 nt, Artificial Sequence
  Description of Artificial Sequence: Synthetic oligonucleotide
cggccgcggacccggcccc

SEQ ID NO: 8222 - RNA, 19 nt, Artificial Sequence
  Description of Artificial Sequence: Synthetic oligonucleotide
ccggccgcggacccggccc

SEQ ID NO: 8223 - RNA, 19 nt, Artificial Sequence
  Description of Artificial Sequence: Synthetic oligonucleotide
gccggccgcggacccggcc

SEQ ID NO: 8224 - RNA, 19 nt, Artificial Sequence
  Description of Artificial Sequence: Synthetic oligonucleotide
cgccggccgcggacccggc

SEQ ID NO: 8225 - RNA, 19 nt, Artificial Sequence
  Description of Artificial Sequence: Synthetic oligonucleotide
ucgccggccgcggacccgg

SEQ ID NO: 8226 - RNA, 19 nt, Artificial Sequence
  Description of Artificial Sequence: Synthetic oligonucleotide
uucgccggccgcggacccg

SEQ ID NO: 8227 - RNA, 19 nt, Artificial Sequence
  Description of Artificial Sequence: Synthetic oligonucleotide
guucgccggccgcggaccc

SEQ ID NO: 8228 - RNA, 19 nt, Artificial Sequence
  Description of Artificial Sequence: Synthetic oligonucleotide
cguucgccggccgcggacc

SEQ ID NO: 8229 - RNA, 19 nt, Artificial Sequence
  Description of Artificial Sequence: Synthetic oligonucleotide
ccguucgccggccgcggac

SEQ ID NO: 8230 - RNA, 19 nt, Artificial Sequence
  Description of Artificial Sequence: Synthetic oligonucleotide
cccguucgccggccgcgga

SEQ ID NO: 8231 - RNA, 19 nt, Artificial Sequence
  Description of Artificial Sequence: Synthetic oligonucleotide
ccccguucgccggccgcgg

SEQ ID NO: 8232 - RNA, 19 nt, Artificial Sequence
  Description of Artificial Sequence: Synthetic oligonucleotide
gccccguucgccggccgcg

SEQ ID NO: 8233 - RNA, 19 nt, Artificial Sequence
  Description of Artificial Sequence: Synthetic oligonucleotide
agccccguucgccggccgc

SEQ ID NO: 8234 - RNA, 19 nt, Artificial Sequence
  Description of Artificial Sequence: Synthetic oligonucleotide
gagccccguucgccggccg

SEQ ID NO: 8235 - RNA, 19 nt, Artificial Sequence
  Description of Artificial Sequence: Synthetic oligonucleotide
cgagccccguucgccggcc

SEQ ID NO: 8236 - RNA, 19 nt, Artificial Sequence
  Description of Artificial Sequence: Synthetic oligonucleotide
ucgagccccguucgccggc

SEQ ID NO: 8237 - RNA, 19 nt, Artificial Sequence
  Description of Artificial Sequence: Synthetic oligonucleotide
uucgagccccguucgccgg

SEQ ID NO: 8238 - RNA, 19 nt, Artificial Sequence
  Description of Artificial Sequence: Synthetic oligonucleotide
cuucgagccccguucgccg

SEQ ID NO: 8239 - RNA, 19 nt, Artificial Sequence
  Description of Artificial Sequence: Synthetic oligonucleotide
ccuucgagccccguucgcc

SEQ ID NO: 8240 - RNA, 19 nt, Artificial Sequence
  Description of Artificial Sequence: Synthetic oligonucleotide
cccuucgagccccguucgc

SEQ ID NO: 8241 - RNA, 19 nt, Artificial Sequence
  Description of Artificial Sequence: Synthetic oligonucleotide
acccuucgagccccguucg

SEQ ID NO: 8242 - RNA, 19 nt, Artificial Sequence
  Description of Artificial Sequence: Synthetic oligonucleotide
gacccuucgagccccguuc

SEQ ID NO: 8243 - RNA, 19 nt, Artificial Sequence
  Description of Artificial Sequence: Synthetic oligonucleotide
ggacccuucgagccccguu

SEQ ID NO: 8244 - RNA, 19 nt, Artificial Sequence
  Description of Artificial Sequence: Synthetic oligonucleotide
aggacccuucgagccccgu

SEQ ID NO: 8245 - RNA, 19 nt, Artificial Sequence
  Description of Artificial Sequence: Synthetic oligonucleotide
aaggacccuucgagccccg

SEQ ID NO: 8246 - RNA, 19 nt, Artificial Sequence
  Description of Artificial Sequence: Synthetic oligonucleotide
caaggacccuucgagcccc

SEQ ID NO: 8247 - RNA, 19 nt, Artificial Sequence
  Description of Artificial Sequence: Synthetic oligonucleotide
acaaggacccuucgagccc

SEQ ID NO: 8248 - RNA, 19 nt, Artificial Sequence
  Description of Artificial Sequence: Synthetic oligonucleotide
uacaaggacccuucgagcc

SEQ ID NO: 8249 - RNA, 19 nt, Artificial Sequence
  Description of Artificial Sequence: Synthetic oligonucleotide
cuacaaggacccuucgagc

SEQ ID NO: 8250 - RNA, 19 nt, Artificial Sequence
  Description of Artificial Sequence: Synthetic oligonucleotide
gcuacaaggacccuucgag

SEQ ID NO: 8251 - RNA, 19 nt, Artificial Sequence
  Description of Artificial Sequence: Synthetic oligonucleotide
ggcuacaaggacccuucga

SEQ ID NO: 8252 - RNA, 19 nt, Artificial Sequence
  Description of Artificial Sequence: Synthetic oligonucleotide
cggcuacaaggacccuucg

SEQ ID NO: 8253 - RNA, 19 nt, Artificial Sequence
  Description of Artificial Sequence: Synthetic oligonucleotide
ccggcuacaaggacccuuc

SEQ ID NO: 8254 - RNA, 19 nt, Artificial Sequence
  Description of Artificial Sequence: Synthetic oligonucleotide
cccggcuacaaggacccuu

SEQ ID NO: 8255 - RNA, 19 nt, Artificial Sequence
  Description of Artificial Sequence: Synthetic oligonucleotide
ucccggcuacaaggacccu

SEQ ID NO: 8256 - RNA, 19 nt, Artificial Sequence
  Description of Artificial Sequence: Synthetic oligonucleotide
uucccggcuacaaggaccc

SEQ ID NO: 8257 - RNA, 19 nt, Artificial Sequence
  Description of Artificial Sequence: Synthetic oligonucleotide
auucccggcuacaaggacc

SEQ ID NO: 8258 - RNA, 19 nt, Artificial Sequence
  Description of Artificial Sequence: Synthetic oligonucleotide
cauucccggcuacaaggac

SEQ ID NO: 8259 - RNA, 19 nt, Artificial Sequence
  Description of Artificial Sequence: Synthetic oligonucleotide
gcauucccggcuacaagga

SEQ ID NO: 8260 - RNA, 19 nt, Artificial Sequence
  Description of Artificial Sequence: Synthetic oligonucleotide
agcauucccggcuacaagg

SEQ ID NO: 8261 - RNA, 19 nt, Artificial Sequence
  Description of Artificial Sequence: Synthetic oligonucleotide
cagcauucccggcuacaag

SEQ ID NO: 8262 - RNA, 19 nt, Artificial Sequence
  Description of Artificial Sequence: Synthetic oligonucleotide
gcagcauucccggcuacaa

SEQ ID NO: 8263 - RNA, 19 nt, Artificial Sequence
  Description of Artificial Sequence: Synthetic oligonucleotide
agcagcauucccggcuaca

SEQ ID NO: 8264 - RNA, 19 nt, Artificial Sequence
  Description of Artificial Sequence: Synthetic oligonucleotide
cagcagcauucccggcuac

SEQ ID NO: 8265 - RNA, 19 nt, Artificial Sequence
  Description of Artificial Sequence: Synthetic oligonucleotide
gcagcagcauucccggcua

SEQ ID NO: 8266 - RNA, 19 nt, Artificial Sequence
  Description of Artificial Sequence: Synthetic oligonucleotide
agcagcagcauucccggcu

SEQ ID NO: 8267 - RNA, 19 nt, Artificial Sequence
  Description of Artificial Sequence: Synthetic oligonucleotide
cagcagcagcauucccggc

SEQ ID NO: 8268 - RNA, 19 nt, Artificial Sequence
  Description of Artificial Sequence: Synthetic oligonucleotide
gcagcagcagcauucccgg

SEQ ID NO: 8269 - RNA, 19 nt, Artificial Sequence
  Description of Artificial Sequence: Synthetic oligonucleotide
agcagcagcagcauucccg

SEQ ID NO: 8270 - RNA, 19 nt, Artificial Sequence
  Description of Artificial Sequence: Synthetic oligonucleotide
cagcagcagcagcauuccc

SEQ ID NO: 8271 - RNA, 19 nt, Artificial Sequence
  Description of Artificial Sequence: Synthetic oligonucleotide
gcagcagcagcagcauucc

SEQ ID NO: 8272 - RNA, 19 nt, Artificial Sequence
  Description of Artificial Sequence: Synthetic oligonucleotide
agcagcagcagcagcauuc

SEQ ID NO: 8273 - RNA, 19 nt, Artificial Sequence
  Description of Artificial Sequence: Synthetic oligonucleotide
cagcagcagcagcagcauu

SEQ ID NO: 8274 - RNA, 19 nt, Artificial Sequence
  Description of Artificial Sequence: Synthetic oligonucleotide
gcagcagcagcagcagcau

SEQ ID NO: 8275 - RNA, 19 nt, Artificial Sequence
  Description of Artificial Sequence: Synthetic oligonucleotide
agcagcagcagcagcagca

SEQ ID NO: 8276 - RNA, 19 nt, Artificial Sequence
  Description of Artificial Sequence: Synthetic oligonucleotide
cagcagcagcagcagcagc

SEQ ID NO: 8277 - RNA, 19 nt, Artificial Sequence
  Description of Artificial Sequence: Synthetic oligonucleotide
gcagcagcagcagcagcag

SEQ ID NO: 8278 - RNA, 19 nt, Artificial Sequence
  Description of Artificial Sequence: Synthetic oligonucleotide
agcagcagcagcagcagca

SEQ ID NO: 8279 - RNA, 19 nt, Artificial Sequence
  Description of Artificial Sequence: Synthetic oligonucleotide
cagcagcagcagcagcagc

SEQ ID NO: 8280 - RNA, 19 nt, Artificial Sequence
  Description of Artificial Sequence: Synthetic oligonucleotide
gcagcagcagcagcagcag

SEQ ID NO: 8281 - RNA, 19 nt, Artificial Sequence
  Description of Artificial Sequence: Synthetic oligonucleotide
agcagcagcagcagcagca

SEQ ID NO: 8282 - RNA, 19 nt, Artificial Sequence
  Description of Artificial Sequence: Synthetic oligonucleotide
cagcagcagcagcagcagc

SEQ ID NO: 8283 - RNA, 19 nt, Artificial Sequence
  Description of Artificial Sequence: Synthetic oligonucleotide
gcagcagcagcagcagcag

SEQ ID NO: 8284 - RNA, 19 nt, Artificial Sequence
  Description of Artificial Sequence: Synthetic oligonucleotide
agcagcagcagcagcagca

SEQ ID NO: 8285 - RNA, 19 nt, Artificial Sequence
  Description of Artificial Sequence: Synthetic oligonucleotide
cagcagcagcagcagcagc

SEQ ID NO: 8286 - RNA, 19 nt, Artificial Sequence
  Description of Artificial Sequence: Synthetic oligonucleotide
gcagcagcagcagcagcag

SEQ ID NO: 8287 - RNA, 19 nt, Artificial Sequence
  Description of Artificial Sequence: Synthetic oligonucleotide
agcagcagcagcagcagca

SEQ ID NO: 8288 - RNA, 19 nt, Artificial Sequence
  Description of Artificial Sequence: Synthetic oligonucleotide
cagcagcagcagcagcagc

SEQ ID NO: 8289 - RNA, 19 nt, Artificial Sequence
  Description of Artificial Sequence: Synthetic oligonucleotide
gcagcagcagcagcagcag

SEQ ID NO: 8290 - RNA, 19 nt, Artificial Sequence
  Description of Artificial Sequence: Synthetic oligonucleotide
agcagcagcagcagcagca

SEQ ID NO: 8291 - RNA, 19 nt, Artificial Sequence
  Description of Artificial Sequence: Synthetic oligonucleotide
cagcagcagcagcagcagc

SEQ ID NO: 8292 - RNA, 19 nt, Artificial Sequence
  Description of Artificial Sequence: Synthetic oligonucleotide
gcagcagcagcagcagcag

SEQ ID NO: 8293 - RNA, 19 nt, Artificial Sequence
  Description of Artificial Sequence: Synthetic oligonucleotide
agcagcagcagcagcagca

SEQ ID NO: 8294 - RNA, 19 nt, Artificial Sequence
  Description of Artificial Sequence: Synthetic oligonucleotide
cagcagcagcagcagcagc

SEQ ID NO: 8295 - RNA, 19 nt, Artificial Sequence
  Description of Artificial Sequence: Synthetic oligonucleotide
gcagcagcagcagcagcag

SEQ ID NO: 8296 - RNA, 19 nt, Artificial Sequence
  Description of Artificial Sequence: Synthetic oligonucleotide
agcagcagcagcagcagca

SEQ ID NO: 8297 - RNA, 19 nt, Artificial Sequence
  Description of Artificial Sequence: Synthetic oligonucleotide
cagcagcagcagcagcagc

SEQ ID NO: 8298 - RNA, 19 nt, Artificial Sequence
  Description of Artificial Sequence: Synthetic oligonucleotide
gcagcagcagcagcagcag

SEQ ID NO: 8299 - RNA, 19 nt, Artificial Sequence
  Description of Artificial Sequence: Synthetic oligonucleotide
agcagcagcagcagcagca

SEQ ID NO: 8300 - RNA, 19 nt, Artificial Sequence
  Description of Artificial Sequence: Synthetic oligonucleotide
cagcagcagcagcagcagc

SEQ ID NO: 8301 - RNA, 19 nt, Artificial Sequence
  Description of Artificial Sequence: Synthetic oligonucleotide
gcagcagcagcagcagcag

SEQ ID NO: 8302 - RNA, 19 nt, Artificial Sequence
  Description of Artificial Sequence: Synthetic oligonucleotide
agcagcagcagcagcagca

SEQ ID NO: 8303 - RNA, 19 nt, Artificial Sequence
  Description of Artificial Sequence: Synthetic oligonucleotide
cagcagcagcagcagcagc

SEQ ID NO: 8304 - RNA, 19 nt, Artificial Sequence
  Description of Artificial Sequence: Synthetic oligonucleotide
gcagcagcagcagcagcag

SEQ ID NO: 8305 - RNA, 19 nt, Artificial Sequence
  Description of Artificial Sequence: Synthetic oligonucleotide
agcagcagcagcagcagca

SEQ ID NO: 8306 - RNA, 19 nt, Artificial Sequence
  Description of Artificial Sequence: Synthetic oligonucleotide
cagcagcagcagcagcagc

SEQ ID NO: 8307 - RNA, 19 nt, Artificial Sequence
  Description of Artificial Sequence: Synthetic oligonucleotide
gcagcagcagcagcagcag

SEQ ID NO: 8308 - RNA, 19 nt, Artificial Sequence
  Description of Artificial Sequence: Synthetic oligonucleotide
agcagcagcagcagcagca

SEQ ID NO: 8309 - RNA, 19 nt, Artificial Sequence
  Description of Artificial Sequence: Synthetic oligonucleotide
cagcagcagcagcagcagc

SEQ ID NO: 8310 - RNA, 19 nt, Artificial Sequence
  Description of Artificial Sequence: Synthetic oligonucleotide
gcagcagcagcagcagcag

SEQ ID NO: 8311 - RNA, 19 nt, Artificial Sequence
  Description of Artificial Sequence: Synthetic oligonucleotide
agcagcagcagcagcagca

SEQ ID NO: 8312 - RNA, 19 nt, Artificial Sequence
  Description of Artificial Sequence: Synthetic oligonucleotide
cagcagcagcagcagcagc

SEQ ID NO: 8313 - RNA, 19 nt, Artificial Sequence
  Description of Artificial Sequence: Synthetic oligonucleotide
gcagcagcagcagcagcag

SEQ ID NO: 8314 - RNA, 19 nt, Artificial Sequence
  Description of Artificial Sequence: Synthetic oligonucleotide
agcagcagcagcagcagca

SEQ ID NO: 8315 - RNA, 19 nt, Artificial Sequence
  Description of Artificial Sequence: Synthetic oligonucleotide
cagcagcagcagcagcagc

SEQ ID NO: 8316 - RNA, 19 nt, Artificial Sequence
  Description of Artificial Sequence: Synthetic oligonucleotide
gcagcagcagcagcagcag

SEQ ID NO: 8317 - RNA, 19 nt, Artificial Sequence
  Description of Artificial Sequence: Synthetic oligonucleotide
agcagcagcagcagcagca

SEQ ID NO: 8318 - RNA, 19 nt, Artificial Sequence
  Description of Artificial Sequence: Synthetic oligonucleotide
cagcagcagcagcagcagc

SEQ ID NO: 8319 - RNA, 19 nt, Artificial Sequence
  Description of Artificial Sequence: Synthetic oligonucleotide
ccagcagcagcagcagcag

SEQ ID NO: 8320 - RNA, 19 nt, Artificial Sequence
  Description of Artificial Sequence: Synthetic oligonucleotide
cccagcagcagcagcagca

SEQ ID NO: 8321 - RNA, 19 nt, Artificial Sequence
  Description of Artificial Sequence: Synthetic oligonucleotide
ccccagcagcagcagcagc

SEQ ID NO: 8322 - RNA, 19 nt, Artificial Sequence
  Description of Artificial Sequence: Synthetic oligonucleotide
cccccagcagcagcagcag

SEQ ID NO: 8323 - RNA, 19 nt, Artificial Sequence
  Description of Artificial Sequence: Synthetic oligonucleotide
ccccccagcagcagcagca

SEQ ID NO: 8324 - RNA, 19 nt, Artificial Sequence
  Description of Artificial Sequence: Synthetic oligonucleotide
uccccccagcagcagcagc

SEQ ID NO: 8325 - RNA, 19 nt, Artificial Sequence
  Description of Artificial Sequence: Synthetic oligonucleotide
auccccccagcagcagcag

SEQ ID NO: 8326 - RNA, 19 nt, Artificial Sequence
  Description of Artificial Sequence: Synthetic oligonucleotide
gauccccccagcagcagca

SEQ ID NO: 8327 - RNA, 19 nt, Artificial Sequence
  Description of Artificial Sequence: Synthetic oligonucleotide
ugauccccccagcagcagc

SEQ ID NO: 8328 - RNA, 19 nt, Artificial Sequence
  Description of Artificial Sequence: Synthetic oligonucleotide
gugauccccccagcagcag

SEQ ID NO: 8329 - RNA, 19 nt, Artificial Sequence
  Description of Artificial Sequence: Synthetic oligonucleotide
ugugauccccccagcagca

SEQ ID NO: 8330 - RNA, 19 nt, Artificial Sequence
  Description of Artificial Sequence: Synthetic oligonucleotide
cugugauccccccagcagc

SEQ ID NO: 8331 - RNA, 19 nt, Artificial Sequence
  Description of Artificial Sequence: Synthetic oligonucleotide
ucugugauccccccagcag

SEQ ID NO: 8332 - RNA, 19 nt, Artificial Sequence
  Description of Artificial Sequence: Synthetic oligonucleotide
gucugugauccccccagca

SEQ ID NO: 8333 - RNA, 19 nt, Artificial Sequence
  Description of Artificial Sequence: Synthetic oligonucleotide
ggucugugauccccccagc

SEQ ID NO: 8334 - RNA, 19 nt, Artificial Sequence
  Description of Artificial Sequence: Synthetic oligonucleotide
uggucugugauccccccag

SEQ ID NO: 8335 - RNA, 19 nt, Artificial Sequence
  Description of Artificial Sequence: Synthetic oligonucleotide
auggucugugaucccccca

SEQ ID NO: 8336 - RNA, 19 nt, Artificial Sequence
  Description of Artificial Sequence: Synthetic oligonucleotide
aauggucugugaucccccc

SEQ ID NO: 8337 - RNA, 19 nt, Artificial Sequence
  Description of Artificial Sequence: Synthetic oligonucleotide
aaauggucugugauccccc

SEQ ID NO: 8338 - RNA, 19 nt, Artificial Sequence
  Description of Artificial Sequence: Synthetic oligonucleotide
gaaauggucugugaucccc

SEQ ID NO: 8339 - RNA, 19 nt, Artificial Sequence
  Description of Artificial Sequence: Synthetic oligonucleotide
agaaauggucugugauccc

SEQ ID NO: 8340 - RNA, 19 nt, Artificial Sequence
  Description of Artificial Sequence: Synthetic oligonucleotide
aagaaauggucugugaucc

SEQ ID NO: 8341 - RNA, 19 nt, Artificial Sequence
  Description of Artificial Sequence: Synthetic oligonucleotide
aaagaaauggucugugauc

SEQ ID NO: 8342 - RNA, 19 nt, Artificial Sequence
  Description of Artificial Sequence: Synthetic oligonucleotide
gaaagaaauggucugugau

SEQ ID NO: 8343 - RNA, 19 nt, Artificial Sequence
  Description of Artificial Sequence: Synthetic oligonucleotide
agaaagaaauggucuguga

SEQ ID NO: 8344 - RNA, 19 nt, Artificial Sequence
  Description of Artificial Sequence: Synthetic oligonucleotide
aagaaagaaauggucugug

SEQ ID NO: 8345 - RNA, 19 nt, Artificial Sequence
  Description of Artificial Sequence: Synthetic oligonucleotide
aaagaaagaaauggucugu

SEQ ID NO: 8346 - RNA, 19 nt, Artificial Sequence
  Description of Artificial Sequence: Synthetic oligonucleotide
gaaagaaagaaauggucug

SEQ ID NO: 8347 - RNA, 19 nt, Artificial Sequence
  Description of Artificial Sequence: Synthetic oligonucleotide
cgaaagaaagaaauggucu

SEQ ID NO: 8348 - RNA, 19 nt, Artificial Sequence
  Description of Artificial Sequence: Synthetic oligonucleotide
ccgaaagaaagaaaugguc

SEQ ID NO: 8349 - RNA, 19 nt, Artificial Sequence
  Description of Artificial Sequence: Synthetic oligonucleotide
gccgaaagaaagaaauggu

SEQ ID NO: 8350 - RNA, 19 nt, Artificial Sequence
  Description of Artificial Sequence: Synthetic oligonucleotide
ggccgaaagaaagaaaugg

SEQ ID NO: 8351 - RNA, 19 nt, Artificial Sequence
  Description of Artificial Sequence: Synthetic oligonucleotide
uggccgaaagaaagaaaug

SEQ ID NO: 8352 - RNA, 19 nt, Artificial Sequence
  Description of Artificial Sequence: Synthetic oligonucleotide
cuggccgaaagaaagaaau

SEQ ID NO: 8353 - RNA, 19 nt, Artificial Sequence
  Description of Artificial Sequence: Synthetic oligonucleotide
ccuggccgaaagaaagaaa

SEQ ID NO: 8354 - RNA, 19 nt, Artificial Sequence
  Description of Artificial Sequence: Synthetic oligonucleotide
gccuggccgaaagaaagaa

SEQ ID NO: 8355 - RNA, 19 nt, Artificial Sequence
  Description of Artificial Sequence: Synthetic oligonucleotide
agccuggccgaaagaaaga

SEQ ID NO: 8356 - RNA, 19 nt, Artificial Sequence
  Description of Artificial Sequence: Synthetic oligonucleotide
cagccuggccgaaagaaag

SEQ ID NO: 8357 - RNA, 19 nt, Artificial Sequence
  Description of Artificial Sequence: Synthetic oligonucleotide
ucagccuggccgaaagaaa

SEQ ID NO: 8358 - RNA, 19 nt, Artificial Sequence
  Description of Artificial Sequence: Synthetic oligonucleotide
cucagccuggccgaaagaa

SEQ ID NO: 8359 - RNA, 19 nt, Artificial Sequence
  Description of Artificial Sequence: Synthetic oligonucleotide
ccucagccuggccgaaaga

SEQ ID NO: 8360 - RNA, 19 nt, Artificial Sequence
  Description of Artificial Sequence: Synthetic oligonucleotide
gccucagccuggccgaaag

SEQ ID NO: 8361 - RNA, 19 nt, Artificial Sequence
  Description of Artificial Sequence: Synthetic oligonucleotide
ggccucagccuggccgaaa

SEQ ID NO: 8362 - RNA, 19 nt, Artificial Sequence
  Description of Artificial Sequence: Synthetic oligonucleotide
gggccucagccuggccgaa

SEQ ID NO: 8363 - RNA, 19 nt, Artificial Sequence
  Description of Artificial Sequence: Synthetic oligonucleotide
agggccucagccuggccga

SEQ ID NO: 8364 - RNA, 19 nt, Artificial Sequence
  Description of Artificial Sequence: Synthetic oligonucleotide
cagggccucagccuggccg

SEQ ID NO: 8365 - RNA, 19 nt, Artificial Sequence
  Description of Artificial Sequence: Synthetic oligonucleotide
ucagggccucagccuggcc

SEQ ID NO: 8366 - RNA, 19 nt, Artificial Sequence
  Description of Artificial Sequence: Synthetic oligonucleotide
gucagggccucagccuggc

SEQ ID NO: 8367 - RNA, 19 nt, Artificial Sequence
  Description of Artificial Sequence: Synthetic oligonucleotide
cgucagggccucagccugg

SEQ ID NO: 8368 - RNA, 19 nt, Artificial Sequence
  Description of Artificial Sequence: Synthetic oligonucleotide
acgucagggccucagccug

SEQ ID NO: 8369 - RNA, 19 nt, Artificial Sequence
  Description of Artificial Sequence: Synthetic oligonucleotide
cacgucagggccucagccu

SEQ ID NO: 8370 - RNA, 19 nt, Artificial Sequence
  Description of Artificial Sequence: Synthetic oligonucleotide
ccacgucagggccucagcc

SEQ ID NO: 8371 - RNA, 19 nt, Artificial Sequence
  Description of Artificial Sequence: Synthetic oligonucleotide
uccacgucagggccucagc

SEQ ID NO: 8372 - RNA, 19 nt, Artificial Sequence
  Description of Artificial Sequence: Synthetic oligonucleotide
auccacgucagggccucag

SEQ ID NO: 8373 - RNA, 19 nt, Artificial Sequence
  Description of Artificial Sequence: Synthetic oligonucleotide
cauccacgucagggccuca

SEQ ID NO: 8374 - RNA, 19 nt, Artificial Sequence
  Description of Artificial Sequence: Synthetic oligonucleotide
ccauccacgucagggccuc

SEQ ID NO: 8375 - RNA, 19 nt, Artificial Sequence
  Description of Artificial Sequence: Synthetic oligonucleotide
cccauccacgucagggccu

SEQ ID NO: 8376 - RNA, 19 nt, Artificial Sequence
  Description of Artificial Sequence: Synthetic oligonucleotide
gcccauccacgucagggcc

SEQ ID NO: 8377 - RNA, 19 nt, Artificial Sequence
  Description of Artificial Sequence: Synthetic oligonucleotide
ugcccauccacgucagggc

SEQ ID NO: 8378 - RNA, 19 nt, Artificial Sequence
  Description of Artificial Sequence: Synthetic oligonucleotide
uugcccauccacgucaggg

SEQ ID NO: 8379 - RNA, 19 nt, Artificial Sequence
  Description of Artificial Sequence: Synthetic oligonucleotide
uuugcccauccacgucagg

SEQ ID NO: 8380 - RNA, 19 nt, Artificial Sequence
  Description of Artificial Sequence: Synthetic oligonucleotide
guuugcccauccacgucag

SEQ ID NO: 8381 - RNA, 19 nt, Artificial Sequence
  Description of Artificial Sequence: Synthetic oligonucleotide
aguuugcccauccacguca

SEQ ID NO: 8382 - RNA, 19 nt, Artificial Sequence
  Description of Artificial Sequence: Synthetic oligonucleotide
caguuugcccauccacguc

SEQ ID NO: 8383 - RNA, 19 nt, Artificial Sequence
  Description of Artificial Sequence: Synthetic oligonucleotide
gcaguuugcccauccacgu

SEQ ID NO: 8384 - RNA, 19 nt, Artificial Sequence
  Description of Artificial Sequence: Synthetic oligonucleotide
ugcaguuugcccauccacg

SEQ ID NO: 8385 - RNA, 19 nt, Artificial Sequence
  Description of Artificial Sequence: Synthetic oligonucleotide
cugcaguuugcccauccac

SEQ ID NO: 8386 - RNA, 19 nt, Artificial Sequence
  Description of Artificial Sequence: Synthetic oligonucleotide
ccugcaguuugcccaucca

SEQ ID NO: 8387 - RNA, 19 nt, Artificial Sequence
  Description of Artificial Sequence: Synthetic oligonucleotide
gccugcaguuugcccaucc

SEQ ID NO: 8388 - RNA, 19 nt, Artificial Sequence
  Description of Artificial Sequence: Synthetic oligonucleotide
ggccugcaguuugcccauc

SEQ ID NO: 8389 - RNA, 19 nt, Artificial Sequence
  Description of Artificial Sequence: Synthetic oligonucleotide
aggccugcaguuugcccau

SEQ ID NO: 8390 - RNA, 19 nt, Artificial Sequence
  Description of Artificial Sequence: Synthetic oligonucleotide
caggccugcaguuugccca

SEQ ID NO: 8391 - RNA, 19 nt, Artificial Sequence
  Description of Artificial Sequence: Synthetic oligonucleotide
ccaggccugcaguuugccc

SEQ ID NO: 8392 - RNA, 19 nt, Artificial Sequence
  Description of Artificial Sequence: Synthetic oligonucleotide
cccaggccugcaguuugcc

SEQ ID NO: 8393 - RNA, 19 nt, Artificial Sequence
  Description of Artificial Sequence: Synthetic oligonucleotide
ucccaggccugcaguuugc

SEQ ID NO: 8394 - RNA, 19 nt, Artificial Sequence
  Description of Artificial Sequence: Synthetic oligonucleotide
uucccaggccugcaguuug

SEQ ID NO: 8395 - RNA, 19 nt, Artificial Sequence
  Description of Artificial Sequence: Synthetic oligonucleotide
cuucccaggccugcaguuu

SEQ ID NO: 8396 - RNA, 19 nt, Artificial Sequence
  Description of Artificial Sequence: Synthetic oligonucleotide
ccuucccaggccugcaguu

SEQ ID NO: 8397 - RNA, 19 nt, Artificial Sequence
  Description of Artificial Sequence: Synthetic oligonucleotide
gccuucccaggccugcagu

SEQ ID NO: 8398 - RNA, 19 nt, Artificial Sequence
  Description of Artificial Sequence: Synthetic oligonucleotide
ugccuucccaggccugcag

SEQ ID NO: 8399 - RNA, 19 nt, Artificial Sequence
  Description of Artificial Sequence: Synthetic oligonucleotide
cugccuucccaggccugca

SEQ ID NO: 8400 - RNA, 19 nt, Artificial Sequence
  Description of Artificial Sequence: Synthetic oligonucleotide
gcugccuucccaggccugc

SEQ ID NO: 8401 - RNA, 19 nt, Artificial Sequence
  Description of Artificial Sequence: Synthetic oligonucleotide
ugcugccuucccaggccug

SEQ ID NO: 8402 - RNA, 19 nt, Artificial Sequence
  Description of Artificial Sequence: Synthetic oligonucleotide
uugcugccuucccaggccu

SEQ ID NO: 8403 - RNA, 19 nt, Artificial Sequence
  Description of Artificial Sequence: Synthetic oligonucleotide
cuugcugccuucccaggcc

SEQ ID NO: 8404 - RNA, 19 nt, Artificial Sequence
  Description of Artificial Sequence: Synthetic oligonucleotide
gcuugcugccuucccaggc

SEQ ID NO: 8405 - RNA, 19 nt, Artificial Sequence
  Description of Artificial Sequence: Synthetic oligonucleotide
ggcuugcugccuucccagg

SEQ ID NO: 8406 - RNA, 19 nt, Artificial Sequence
  Description of Artificial Sequence: Synthetic oligonucleotide
cggcuugcugccuucccag

SEQ ID NO: 8407 - RNA, 19 nt, Artificial Sequence
  Description of Artificial Sequence: Synthetic oligonucleotide
ccggcuugcugccuuccca

SEQ ID NO: 8408 - RNA, 19 nt, Artificial Sequence
  Description of Artificial Sequence: Synthetic oligonucleotide
cccggcuugcugccuuccc

SEQ ID NO: 8409 - RNA, 19 nt, Artificial Sequence
  Description of Artificial Sequence: Synthetic oligonucleotide
gcccggcuugcugccuucc

SEQ ID NO: 8410 - RNA, 19 nt, Artificial Sequence
  Description of Artificial Sequence: Synthetic oligonucleotide
ggcccggcuugcugccuuc

SEQ ID NO: 8411 - RNA, 19 nt, Artificial Sequence
  Description of Artificial Sequence: Synthetic oligonucleotide
cggcccggcuugcugccuu

SEQ ID NO: 8412 - RNA, 19 nt, Artificial Sequence
  Description of Artificial Sequence: Synthetic oligonucleotide
acggcccggcuugcugccu

SEQ ID NO: 8413 - RNA, 19 nt, Artificial Sequence
  Description of Artificial Sequence: Synthetic oligonucleotide
gacggcccggcuugcugcc

SEQ ID NO: 8414 - RNA, 19 nt, Artificial Sequence
  Description of Artificial Sequence: Synthetic oligonucleotide
ggacggcccggcuugcugc

SEQ ID NO: 8415 - RNA, 19 nt, Artificial Sequence
  Description of Artificial Sequence: Synthetic oligonucleotide
cggacggcccggcuugcug

SEQ ID NO: 8416 - RNA, 19 nt, Artificial Sequence
  Description of Artificial Sequence: Synthetic oligonucleotide
acggacggcccggcuugcu

SEQ ID NO: 8417 - RNA, 19 nt, Artificial Sequence
  Description of Artificial Sequence: Synthetic oligonucleotide
cacggacggcccggcuugc

SEQ ID NO: 8418 - RNA, 19 nt, Artificial Sequence
  Description of Artificial Sequence: Synthetic oligonucleotide
acacggacggcccggcuug

SEQ ID NO: 8419 - RNA, 19 nt, Artificial Sequence
  Description of Artificial Sequence: Synthetic oligonucleotide
aacacggacggcccggcuu

SEQ ID NO: 8420 - RNA, 19 nt, Artificial Sequence
  Description of Artificial Sequence: Synthetic oligonucleotide
gaacacggacggcccggcu

SEQ ID NO: 8421 - RNA, 19 nt, Artificial Sequence
  Description of Artificial Sequence: Synthetic oligonucleotide
ggaacacggacggcccggc

SEQ ID NO: 8422 - RNA, 19 nt, Artificial Sequence
  Description of Artificial Sequence: Synthetic oligonucleotide
uggaacacggacggcccgg

SEQ ID NO: 8423 - RNA, 19 nt, Artificial Sequence
  Description of Artificial Sequence: Synthetic oligonucleotide
auggaacacggacggcccg

SEQ ID NO: 8424 - RNA, 19 nt, Artificial Sequence
  Description of Artificial Sequence: Synthetic oligonucleotide
gauggaacacggacggccc

SEQ ID NO: 8425 - RNA, 19 nt, Artificial Sequence
  Description of Artificial Sequence: Synthetic oligonucleotide
ggauggaacacggacggcc

SEQ ID NO: 8426 - RNA, 19 nt, Artificial Sequence
  Description of Artificial Sequence: Synthetic oligonucleotide
aggauggaacacggacggc

SEQ ID NO: 8427 - RNA, 19 nt, Artificial Sequence
  Description of Artificial Sequence: Synthetic oligonucleotide
gaggauggaacacggacgg

SEQ ID NO: 8428 - RNA, 19 nt, Artificial Sequence
  Description of Artificial Sequence: Synthetic oligonucleotide
ggaggauggaacacggacg

SEQ ID NO: 8429 - RNA, 19 nt, Artificial Sequence
  Description of Artificial Sequence: Synthetic oligonucleotide
uggaggauggaacacggac

SEQ ID NO: 8430 - RNA, 19 nt, Artificial Sequence
  Description of Artificial Sequence: Synthetic oligonucleotide
guggaggauggaacacgga

SEQ ID NO: 8431 - RNA, 19 nt, Artificial Sequence
  Description of Artificial Sequence: Synthetic oligonucleotide
cguggaggauggaacacgg

SEQ ID NO: 8432 - RNA, 19 nt, Artificial Sequence
  Description of Artificial Sequence: Synthetic oligonucleotide
gcguggaggauggaacacg

SEQ ID NO: 8433 - RNA, 19 nt, Artificial Sequence
  Description of Artificial Sequence: Synthetic oligonucleotide
ugcguggaggauggaacac

SEQ ID NO: 8434 - RNA, 19 nt, Artificial Sequence
  Description of Artificial Sequence: Synthetic oligonucleotide
gugcguggaggauggaaca

SEQ ID NO: 8435 - RNA, 19 nt, Artificial Sequence
  Description of Artificial Sequence: Synthetic oligonucleotide
ggugcguggaggauggaac

SEQ ID NO: 8436 - RNA, 19 nt, Artificial Sequence
  Description of Artificial Sequence: Synthetic oligonucleotide
gggugcguggaggauggaa

SEQ ID NO: 8437 - RNA, 19 nt, Artificial Sequence
  Description of Artificial Sequence: Synthetic oligonucleotide
ggggugcguggaggaugga

SEQ ID NO: 8438 - RNA, 19 nt, Artificial Sequence
  Description of Artificial Sequence: Synthetic oligonucleotide
gggggugcguggaggaugg

SEQ ID NO: 8439 - RNA, 19 nt, Artificial Sequence
  Description of Artificial Sequence: Synthetic oligonucleotide
ugggggugcguggaggaug

SEQ ID NO: 8440 - RNA, 19 nt, Artificial Sequence
  Description of Artificial Sequence: Synthetic oligonucleotide
gugggggugcguggaggau

SEQ ID NO: 8441 - RNA, 19 nt, Artificial Sequence
  Description of Artificial Sequence: Synthetic oligonucleotide
ggugggggugcguggagga

SEQ ID NO: 8442 - RNA, 19 nt, Artificial Sequence
  Description of Artificial Sequence: Synthetic oligonucleotide
aggugggggugcguggagg

SEQ ID NO: 8443 - RNA, 19 nt, Artificial Sequence
  Description of Artificial Sequence: Synthetic oligonucleotide
uaggugggggugcguggag

SEQ ID NO: 8444 - RNA, 19 nt, Artificial Sequence
  Description of Artificial Sequence: Synthetic oligonucleotide
auaggugggggugcgugga

SEQ ID NO: 8445 - RNA, 19 nt, Artificial Sequence
  Description of Artificial Sequence: Synthetic oligonucleotide
gauaggugggggugcgugg

SEQ ID NO: 8446 - RNA, 19 nt, Artificial Sequence
  Description of Artificial Sequence: Synthetic oligonucleotide
cgauaggugggggugcgug

SEQ ID NO: 8447 - RNA, 19 nt, Artificial Sequence
  Description of Artificial Sequence: Synthetic oligonucleotide
acgauaggugggggugcgu

SEQ ID NO: 8448 - RNA, 19 nt, Artificial Sequence
  Description of Artificial Sequence: Synthetic oligonucleotide
aacgauaggugggggugcg

SEQ ID NO: 8449 - RNA, 19 nt, Artificial Sequence
  Description of Artificial Sequence: Synthetic oligonucleotide
caacgauaggugggggugc

SEQ ID NO: 8450 - RNA, 19 nt, Artificial Sequence
  Description of Artificial Sequence: Synthetic oligonucleotide
ccaacgauaggugggggug

SEQ ID NO: 8451 - RNA, 19 nt, Artificial Sequence
  Description of Artificial Sequence: Synthetic oligonucleotide
accaacgauaggugggggu

SEQ ID NO: 8452 - RNA, 19 nt, Artificial Sequence
  Description of Artificial Sequence: Synthetic oligonucleotide
aaccaacgauagguggggg

SEQ ID NO: 8453 - RNA, 19 nt, Artificial Sequence
  Description of Artificial Sequence: Synthetic oligonucleotide
gaaccaacgauaggugggg

SEQ ID NO: 8454 - RNA, 19 nt, Artificial Sequence
  Description of Artificial Sequence: Synthetic oligonucleotide
cgaaccaacgauagguggg

SEQ ID NO: 8455 - RNA, 19 nt, Artificial Sequence
  Description of Artificial Sequence: Synthetic oligonucleotide
gcgaaccaacgauaggugg

SEQ ID NO: 8456 - RNA, 19 nt, Artificial Sequence
  Description of Artificial Sequence: Synthetic oligonucleotide
ugcgaaccaacgauaggug

SEQ ID NO: 8457 - RNA, 19 nt, Artificial Sequence
  Description of Artificial Sequence: Synthetic oligonucleotide
uugcgaaccaacgauaggu

SEQ ID NO: 8458 - RNA, 19 nt, Artificial Sequence
  Description of Artificial Sequence: Synthetic oligonucleotide
uuugcgaaccaacgauagg

SEQ ID NO: 8459 - RNA, 19 nt, Artificial Sequence
  Description of Artificial Sequence: Synthetic oligonucleotide
cuuugcgaaccaacgauag

SEQ ID NO: 8460 - RNA, 19 nt, Artificial Sequence
  Description of Artificial Sequence: Synthetic oligonucleotide
acuuugcgaaccaacgaua

SEQ ID NO: 8461 - RNA, 19 nt, Artificial Sequence
  Description of Artificial Sequence: Synthetic oligonucleotide
cacuuugcgaaccaacgau

SEQ ID NO: 8462 - RNA, 19 nt, Artificial Sequence
  Description of Artificial Sequence: Synthetic oligonucleotide
gcacuuugcgaaccaacga

SEQ ID NO: 8463 - RNA, 19 nt, Artificial Sequence
  Description of Artificial Sequence: Synthetic oligonucleotide
ugcacuuugcgaaccaacg

SEQ ID NO: 8464 - RNA, 19 nt, Artificial Sequence
  Description of Artificial Sequence: Synthetic oligonucleotide
uugcacuuugcgaaccaac

SEQ ID NO: 8465 - RNA, 19 nt, Artificial Sequence
  Description of Artificial Sequence: Synthetic oligonucleotide
uuugcacuuugcgaaccaa

SEQ ID NO: 8466 - RNA, 19 nt, Artificial Sequence
  Description of Artificial Sequence: Synthetic oligonucleotide
cuuugcacuuugcgaacca

SEQ ID NO: 8467 - RNA, 19 nt, Artificial Sequence
  Description of Artificial Sequence: Synthetic oligonucleotide
gcuuugcacuuugcgaacc

SEQ ID NO: 8468 - RNA, 19 nt, Artificial Sequence
  Description of Artificial Sequence: Synthetic oligonucleotide
agcuuugcacuuugcgaac

SEQ ID NO: 8469 - RNA, 19 nt, Artificial Sequence
  Description of Artificial Sequence: Synthetic oligonucleotide
aagcuuugcacuuugcgaa

SEQ ID NO: 8470 - RNA, 19 nt, Artificial Sequence
  Description of Artificial Sequence: Synthetic oligonucleotide
aaagcuuugcacuuugcga

SEQ ID NO: 8471 - RNA, 19 nt, Artificial Sequence
  Description of Artificial Sequence: Synthetic oligonucleotide
gaaagcuuugcacuuugcg

SEQ ID NO: 8472 - RNA, 19 nt, Artificial Sequence
  Description of Artificial Sequence: Synthetic oligonucleotide
agaaagcuuugcacuuugc

SEQ ID NO: 8473 - RNA, 19 nt, Artificial Sequence
  Description of Artificial Sequence: Synthetic oligonucleotide
aagaaagcuuugcacuuug

SEQ ID NO: 8474 - RNA, 19 nt, Artificial Sequence
  Description of Artificial Sequence: Synthetic oligonucleotide
caagaaagcuuugcacuuu

SEQ ID NO: 8475 - RNA, 19 nt, Artificial Sequence
  Description of Artificial Sequence: Synthetic oligonucleotide
acaagaaagcuuugcacuu

SEQ ID NO: 8476 - RNA, 19 nt, Artificial Sequence
  Description of Artificial Sequence: Synthetic oligonucleotide
cacaagaaagcuuugcacu

SEQ ID NO: 8477 - RNA, 19 nt, Artificial Sequence
  Description of Artificial Sequence: Synthetic oligonucleotide
gcacaagaaagcuuugcac

SEQ ID NO: 8478 - RNA, 19 nt, Artificial Sequence
  Description of Artificial Sequence: Synthetic oligonucleotide
ugcacaagaaagcuuugca

SEQ ID NO: 8479 - RNA, 19 nt, Artificial Sequence
  Description of Artificial Sequence: Synthetic oligonucleotide
augcacaagaaagcuuugc

SEQ ID NO: 8480 - RNA, 19 nt, Artificial Sequence
  Description of Artificial Sequence: Synthetic oligonucleotide
caugcacaagaaagcuuug

SEQ ID NO: 8481 - RNA, 19 nt, Artificial Sequence
  Description of Artificial Sequence: Synthetic oligonucleotide
ucaugcacaagaaagcuuu

SEQ ID NO: 8482 - RNA, 19 nt, Artificial Sequence
  Description of Artificial Sequence: Synthetic oligonucleotide
gucaugcacaagaaagcuu

SEQ ID NO: 8483 - RNA, 19 nt, Artificial Sequence
  Description of Artificial Sequence: Synthetic oligonucleotide
cgucaugcacaagaaagcu

SEQ ID NO: 8484 - RNA, 19 nt, Artificial Sequence
  Description of Artificial Sequence: Synthetic oligonucleotide
gcgucaugcacaagaaagc

SEQ ID NO: 8485 - RNA, 19 nt, Artificial Sequence
  Description of Artificial Sequence: Synthetic oligonucleotide
ggcgucaugcacaagaaag

SEQ ID NO: 8486 - RNA, 19 nt, Artificial Sequence
  Description of Artificial Sequence: Synthetic oligonucleotide
gggcgucaugcacaagaaa

SEQ ID NO: 8487 - RNA, 19 nt, Artificial Sequence
  Description of Artificial Sequence: Synthetic oligonucleotide
agggcgucaugcacaagaa

SEQ ID NO: 8488 - RNA, 19 nt, Artificial Sequence
  Description of Artificial Sequence: Synthetic oligonucleotide
cagggcgucaugcacaaga

SEQ ID NO: 8489 - RNA, 19 nt, Artificial Sequence
  Description of Artificial Sequence: Synthetic oligonucleotide
gcagggcgucaugcacaag

SEQ ID NO: 8490 - RNA, 19 nt, Artificial Sequence
  Description of Artificial Sequence: Synthetic oligonucleotide
agcagggcgucaugcacaa

SEQ ID NO: 8491 - RNA, 19 nt, Artificial Sequence
  Description of Artificial Sequence: Synthetic oligonucleotide
gagcagggcgucaugcaca

SEQ ID NO: 8492 - RNA, 19 nt, Artificial Sequence
  Description of Artificial Sequence: Synthetic oligonucleotide
agagcagggcgucaugcac

SEQ ID NO: 8493 - RNA, 19 nt, Artificial Sequence
  Description of Artificial Sequence: Synthetic oligonucleotide
cagagcagggcgucaugca

SEQ ID NO: 8494 - RNA, 19 nt, Artificial Sequence
  Description of Artificial Sequence: Synthetic oligonucleotide
ccagagcagggcgucaugc

SEQ ID NO: 8495 - RNA, 19 nt, Artificial Sequence
  Description of Artificial Sequence: Synthetic oligonucleotide
cccagagcagggcgucaug

SEQ ID NO: 8496 - RNA, 19 nt, Artificial Sequence
  Description of Artificial Sequence: Synthetic oligonucleotide
ccccagagcagggcgucau

SEQ ID NO: 8497 - RNA, 19 nt, Artificial Sequence
  Description of Artificial Sequence: Synthetic oligonucleotide
uccccagagcagggcguca

SEQ ID NO: 8498 - RNA, 19 nt, Artificial Sequence
  Description of Artificial Sequence: Synthetic oligonucleotide
cuccccagagcagggcguc

SEQ ID NO: 8499 - RNA, 19 nt, Artificial Sequence
  Description of Artificial Sequence: Synthetic oligonucleotide
gcuccccagagcagggcgu

SEQ ID NO: 8500 - RNA, 19 nt, Artificial Sequence
  Description of Artificial Sequence: Synthetic oligonucleotide
cgcuccccagagcagggcg

SEQ ID NO: 8501 - RNA, 19 nt, Artificial Sequence
  Description of Artificial Sequence: Synthetic oligonucleotide
acgcuccccagagcagggc

SEQ ID NO: 8502 - RNA, 19 nt, Artificial Sequence
  Description of Artificial Sequence: Synthetic oligonucleotide
gacgcuccccagagcaggg

SEQ ID NO: 8503 - RNA, 19 nt, Artificial Sequence
  Description of Artificial Sequence: Synthetic oligonucleotide
agacgcuccccagagcagg

SEQ ID NO: 8504 - RNA, 19 nt, Artificial Sequence
  Description of Artificial Sequence: Synthetic oligonucleotide
cagacgcuccccagagcag

SEQ ID NO: 8505 - RNA, 19 nt, Artificial Sequence
  Description of Artificial Sequence: Synthetic oligonucleotide
ccagacgcuccccagagca

SEQ ID NO: 8506 - RNA, 19 nt, Artificial Sequence
  Description of Artificial Sequence: Synthetic oligonucleotide
gccagacgcuccccagagc

SEQ ID NO: 8507 - RNA, 19 nt, Artificial Sequence
  Description of Artificial Sequence: Synthetic oligonucleotide
cgccagacgcuccccagag

SEQ ID NO: 8508 - RNA, 19 nt, Artificial Sequence
  Description of Artificial Sequence: Synthetic oligonucleotide
gcgccagacgcuccccaga

SEQ ID NO: 8509 - RNA, 19 nt, Artificial Sequence
  Description of Artificial Sequence: Synthetic oligonucleotide
cgcgccagacgcuccccag

SEQ ID NO: 8510 - RNA, 19 nt, Artificial Sequence
  Description of Artificial Sequence: Synthetic oligonucleotide
ucgcgccagacgcucccca

SEQ ID NO: 8511 - RNA, 19 nt, Artificial Sequence
  Description of Artificial Sequence: Synthetic oligonucleotide
aucgcgccagacgcucccc

SEQ ID NO: 8512 - RNA, 19 nt, Artificial Sequence
  Description of Artificial Sequence: Synthetic oligonucleotide
gaucgcgccagacgcuccc

SEQ ID NO: 8513 - RNA, 19 nt, Artificial Sequence
  Description of Artificial Sequence: Synthetic oligonucleotide
agaucgcgccagacgcucc

SEQ ID NO: 8514 - RNA, 19 nt, Artificial Sequence
  Description of Artificial Sequence: Synthetic oligonucleotide
gagaucgcgccagacgcuc

SEQ ID NO: 8515 - RNA, 19 nt, Artificial Sequence
  Description of Artificial Sequence: Synthetic oligonucleotide
agagaucgcgccagacgcu

SEQ ID NO: 8516 - RNA, 19 nt, Artificial Sequence
  Description of Artificial Sequence: Synthetic oligonucleotide
cagagaucgcgccagacgc

SEQ ID NO: 8517 - RNA, 19 nt, Artificial Sequence
  Description of Artificial Sequence: Synthetic oligonucleotide
gcagagaucgcgccagacg

SEQ ID NO: 8518 - RNA, 19 nt, Artificial Sequence
  Description of Artificial Sequence: Synthetic oligonucleotide
ggcagagaucgcgccagac

SEQ ID NO: 8519 - RNA, 19 nt, Artificial Sequence
  Description of Artificial Sequence: Synthetic oligonucleotide
aggcagagaucgcgccaga

SEQ ID NO: 8520 - RNA, 19 nt, Artificial Sequence
  Description of Artificial Sequence: Synthetic oligonucleotide
caggcagagaucgcgccag

SEQ ID NO: 8521 - RNA, 19 nt, Artificial Sequence
  Description of Artificial Sequence: Synthetic oligonucleotide
gcaggcagagaucgcgcca

SEQ ID NO: 8522 - RNA, 19 nt, Artificial Sequence
  Description of Artificial Sequence: Synthetic oligonucleotide
agcaggcagagaucgcgcc

SEQ ID NO: 8523 - RNA, 19 nt, Artificial Sequence
  Description of Artificial Sequence: Synthetic oligonucleotide
aagcaggcagagaucgcgc

SEQ ID NO: 8524 - RNA, 19 nt, Artificial Sequence
  Description of Artificial Sequence: Synthetic oligonucleotide
uaagcaggcagagaucgcg

SEQ ID NO: 8525 - RNA, 19 nt, Artificial Sequence
  Description of Artificial Sequence: Synthetic oligonucleotide
guaagcaggcagagaucgc

SEQ ID NO: 8526 - RNA, 19 nt, Artificial Sequence
  Description of Artificial Sequence: Synthetic oligonucleotide
aguaagcaggcagagaucg

SEQ ID NO: 8527 - RNA, 19 nt, Artificial Sequence
  Description of Artificial Sequence: Synthetic oligonucleotide
gaguaagcaggcagagauc

SEQ ID NO: 8528 - RNA, 19 nt, Artificial Sequence
  Description of Artificial Sequence: Synthetic oligonucleotide
cgaguaagcaggcagagau

SEQ ID NO: 8529 - RNA, 19 nt, Artificial Sequence
  Description of Artificial Sequence: Synthetic oligonucleotide
ccgaguaagcaggcagaga

SEQ ID NO: 8530 - RNA, 19 nt, Artificial Sequence
  Description of Artificial Sequence: Synthetic oligonucleotide
cccgaguaagcaggcagag

SEQ ID NO: 8531 - RNA, 19 nt, Artificial Sequence
  Description of Artificial Sequence: Synthetic oligonucleotide
ucccgaguaagcaggcaga

SEQ ID NO: 8532 - RNA, 19 nt, Artificial Sequence
  Description of Artificial Sequence: Synthetic oligonucleotide
uucccgaguaagcaggcag

SEQ ID NO: 8533 - RNA, 19 nt, Artificial Sequence
  Description of Artificial Sequence: Synthetic oligonucleotide
uuucccgaguaagcaggca

SEQ ID NO: 8534 - RNA, 19 nt, Artificial Sequence
  Description of Artificial Sequence: Synthetic oligonucleotide
auuucccgaguaagcaggc

SEQ ID NO: 8535 - RNA, 19 nt, Artificial Sequence
  Description of Artificial Sequence: Synthetic oligonucleotide
aauuucccgaguaagcagg

SEQ ID NO: 8536 - RNA, 19 nt, Artificial Sequence
  Description of Artificial Sequence: Synthetic oligonucleotide
aaauuucccgaguaagcag

SEQ ID NO: 8537 - RNA, 19 nt, Artificial Sequence
  Description of Artificial Sequence: Synthetic oligonucleotide
caaauuucccgaguaagca

SEQ ID NO: 8538 - RNA, 19 nt, Artificial Sequence
  Description of Artificial Sequence: Synthetic oligonucleotide
gcaaauuucccgaguaagc

SEQ ID NO: 8539 - RNA, 19 nt, Artificial Sequence
  Description of Artificial Sequence: Synthetic oligonucleotide
agcaaauuucccgaguaag

SEQ ID NO: 8540 - RNA, 19 nt, Artificial Sequence
  Description of Artificial Sequence: Synthetic oligonucleotide
aagcaaauuucccgaguaa

SEQ ID NO: 8541 - RNA, 19 nt, Artificial Sequence
  Description of Artificial Sequence: Synthetic oligonucleotide
aaagcaaauuucccgagua

SEQ ID NO: 8542 - RNA, 19 nt, Artificial Sequence
  Description of Artificial Sequence: Synthetic oligonucleotide
aaaagcaaauuucccgagu

SEQ ID NO: 8543 - RNA, 19 nt, Artificial Sequence
  Description of Artificial Sequence: Synthetic oligonucleotide
caaaagcaaauuucccgag

SEQ ID NO: 8544 - RNA, 19 nt, Artificial Sequence
  Description of Artificial Sequence: Synthetic oligonucleotide
gcaaaagcaaauuucccga

SEQ ID NO: 8545 - RNA, 19 nt, Artificial Sequence
  Description of Artificial Sequence: Synthetic oligonucleotide
ggcaaaagcaaauuucccg

SEQ ID NO: 8546 - RNA, 19 nt, Artificial Sequence
  Description of Artificial Sequence: Synthetic oligonucleotide
uggcaaaagcaaauuuccc

SEQ ID NO: 8547 - RNA, 19 nt, Artificial Sequence
  Description of Artificial Sequence: Synthetic oligonucleotide
uuggcaaaagcaaauuucc

SEQ ID NO: 8548 - RNA, 19 nt, Artificial Sequence
  Description of Artificial Sequence: Synthetic oligonucleotide
uuuggcaaaagcaaauuuc

SEQ ID NO: 8549 - RNA, 19 nt, Artificial Sequence
  Description of Artificial Sequence: Synthetic oligonucleotide
guuuggcaaaagcaaauuu

SEQ ID NO: 8550 - RNA, 19 nt, Artificial Sequence
  Description of Artificial Sequence: Synthetic oligonucleotide
gguuuggcaaaagcaaauu

SEQ ID NO: 8551 - RNA, 19 nt, Artificial Sequence
  Description of Artificial Sequence: Synthetic oligonucleotide
ggguuuggcaaaagcaaau

SEQ ID NO: 8552 - RNA, 19 nt, Artificial Sequence
  Description of Artificial Sequence: Synthetic oligonucleotide
cggguuuggcaaaagcaaa

SEQ ID NO: 8553 - RNA, 19 nt, Artificial Sequence
  Description of Artificial Sequence: Synthetic oligonucleotide
gcggguuuggcaaaagcaa

SEQ ID NO: 8554 - RNA, 19 nt, Artificial Sequence
  Description of Artificial Sequence: Synthetic oligonucleotide
agcggguuuggcaaaagca

SEQ ID NO: 8555 - RNA, 19 nt, Artificial Sequence
  Description of Artificial Sequence: Synthetic oligonucleotide
aagcggguuuggcaaaagc

SEQ ID NO: 8556 - RNA, 19 nt, Artificial Sequence
  Description of Artificial Sequence: Synthetic oligonucleotide
aaagcggguuuggcaaaag

SEQ ID NO: 8557 - RNA, 19 nt, Artificial Sequence
  Description of Artificial Sequence: Synthetic oligonucleotide
aaaagcggguuuggcaaaa

SEQ ID NO: 8558 - RNA, 19 nt, Artificial Sequence
  Description of Artificial Sequence: Synthetic oligonucleotide
aaaaagcggguuuggcaaa

SEQ ID NO: 8559 - RNA, 19 nt, Artificial Sequence
  Description of Artificial Sequence: Synthetic oligonucleotide
gaaaaagcggguuuggcaa

SEQ ID NO: 8560 - RNA, 19 nt, Artificial Sequence
  Description of Artificial Sequence: Synthetic oligonucleotide
cgaaaaagcggguuuggca

SEQ ID NO: 8561 - RNA, 19 nt, Artificial Sequence
  Description of Artificial Sequence: Synthetic oligonucleotide
ccgaaaaagcggguuuggc

SEQ ID NO: 8562 - RNA, 19 nt, Artificial Sequence
  Description of Artificial Sequence: Synthetic oligonucleotide
cccgaaaaagcggguuugg

SEQ ID NO: 8563 - RNA, 19 nt, Artificial Sequence
  Description of Artificial Sequence: Synthetic oligonucleotide
ccccgaaaaagcggguuug

SEQ ID NO: 8564 - RNA, 19 nt, Artificial Sequence
  Description of Artificial Sequence: Synthetic oligonucleotide
uccccgaaaaagcggguuu

SEQ ID NO: 8565 - RNA, 19 nt, Artificial Sequence
  Description of Artificial Sequence: Synthetic oligonucleotide
auccccgaaaaagcggguu

SEQ ID NO: 8566 - RNA, 19 nt, Artificial Sequence
  Description of Artificial Sequence: Synthetic oligonucleotide
gauccccgaaaaagcgggu

SEQ ID NO: 8567 - RNA, 19 nt, Artificial Sequence
  Description of Artificial Sequence: Synthetic oligonucleotide
ggauccccgaaaaagcggg

SEQ ID NO: 8568 - RNA, 19 nt, Artificial Sequence
  Description of Artificial Sequence: Synthetic oligonucleotide
gggauccccgaaaaagcgg

SEQ ID NO: 8569 - RNA, 19 nt, Artificial Sequence
  Description of Artificial Sequence: Synthetic oligonucleotide
cgggauccccgaaaaagcg

SEQ ID NO: 8570 - RNA, 19 nt, Artificial Sequence
  Description of Artificial Sequence: Synthetic oligonucleotide
gcgggauccccgaaaaagc

SEQ ID NO: 8571 - RNA, 19 nt, Artificial Sequence
  Description of Artificial Sequence: Synthetic oligonucleotide
cgcgggauccccgaaaaag

SEQ ID NO: 8572 - RNA, 19 nt, Artificial Sequence
  Description of Artificial Sequence: Synthetic oligonucleotide
gcgcgggauccccgaaaaa

SEQ ID NO: 8573 - RNA, 19 nt, Artificial Sequence
  Description of Artificial Sequence: Synthetic oligonucleotide
ggcgcgggauccccgaaaa

SEQ ID NO: 8574 - RNA, 19 nt, Artificial Sequence
  Description of Artificial Sequence: Synthetic oligonucleotide
gggcgcgggauccccgaaa

SEQ ID NO: 8575 - RNA, 19 nt, Artificial Sequence
  Description of Artificial Sequence: Synthetic oligonucleotide
ggggcgcgggauccccgaa

SEQ ID NO: 8576 - RNA, 19 nt, Artificial Sequence
  Description of Artificial Sequence: Synthetic oligonucleotide
gggggcgcgggauccccga

SEQ ID NO: 8577 - RNA, 19 nt, Artificial Sequence
  Description of Artificial Sequence: Synthetic oligonucleotide
ggggggcgcgggauccccg

SEQ ID NO: 8578 - RNA, 19 nt, Artificial Sequence
  Description of Artificial Sequence: Synthetic oligonucleotide
aggggggcgcgggaucccc

SEQ ID NO: 8579 - RNA, 19 nt, Artificial Sequence
  Description of Artificial Sequence: Synthetic oligonucleotide
gaggggggcgcgggauccc

SEQ ID NO: 8580 - RNA, 19 nt, Artificial Sequence
  Description of Artificial Sequence: Synthetic oligonucleotide
ggaggggggcgcgggaucc

SEQ ID NO: 8581 - RNA, 19 nt, Artificial Sequence
  Description of Artificial Sequence: Synthetic oligonucleotide
aggaggggggcgcgggauc

SEQ ID NO: 8582 - RNA, 19 nt, Artificial Sequence
  Description of Artificial Sequence: Synthetic oligonucleotide
gaggaggggggcgcgggau

SEQ ID NO: 8583 - RNA, 19 nt, Artificial Sequence
  Description of Artificial Sequence: Synthetic oligonucleotide
ugaggaggggggcgcggga

SEQ ID NO: 8584 - RNA, 19 nt, Artificial Sequence
  Description of Artificial Sequence: Synthetic oligonucleotide
gugaggaggggggcgcggg

SEQ ID NO: 8585 - RNA, 19 nt, Artificial Sequence
  Description of Artificial Sequence: Synthetic oligonucleotide
agugaggaggggggcgcgg

SEQ ID NO: 8586 - RNA, 19 nt, Artificial Sequence
  Description of Artificial Sequence: Synthetic oligonucleotide
aagugaggaggggggcgcg

SEQ ID NO: 8587 - RNA, 19 nt, Artificial Sequence
  Description of Artificial Sequence: Synthetic oligonucleotide
caagugaggaggggggcgc

SEQ ID NO: 8588 - RNA, 19 nt, Artificial Sequence
  Description of Artificial Sequence: Synthetic oligonucleotide
gcaagugaggaggggggcg

SEQ ID NO: 8589 - RNA, 19 nt, Artificial Sequence
  Description of Artificial Sequence: Synthetic oligonucleotide
cgcaagugaggaggggggc

SEQ ID NO: 8590 - RNA, 19 nt, Artificial Sequence
  Description of Artificial Sequence: Synthetic oligonucleotide
gcgcaagugaggagggggg

SEQ ID NO: 8591 - RNA, 19 nt, Artificial Sequence
  Description of Artificial Sequence: Synthetic oligonucleotide
agcgcaagugaggaggggg

SEQ ID NO: 8592 - RNA, 19 nt, Artificial Sequence
  Description of Artificial Sequence: Synthetic oligonucleotide
cagcgcaagugaggagggg

SEQ ID NO: 8593 - RNA, 19 nt, Artificial Sequence
  Description of Artificial Sequence: Synthetic oligonucleotide
gcagcgcaagugaggaggg

SEQ ID NO: 8594 - RNA, 19 nt, Artificial Sequence
  Description of Artificial Sequence: Synthetic oligonucleotide
agcagcgcaagugaggagg

SEQ ID NO: 8595 - RNA, 19 nt, Artificial Sequence
  Description of Artificial Sequence: Synthetic oligonucleotide
gagcagcgcaagugaggag

SEQ ID NO: 8596 - RNA, 19 nt, Artificial Sequence
  Description of Artificial Sequence: Synthetic oligonucleotide
agagcagcgcaagugagga

SEQ ID NO: 8597 - RNA, 19 nt, Artificial Sequence
  Description of Artificial Sequence: Synthetic oligonucleotide
gagagcagcgcaagugagg

SEQ ID NO: 8598 - RNA, 19 nt, Artificial Sequence
  Description of Artificial Sequence: Synthetic oligonucleotide
cgagagcagcgcaagugag

SEQ ID NO: 8599 - RNA, 19 nt, Artificial Sequence
  Description of Artificial Sequence: Synthetic oligonucleotide
ccgagagcagcgcaaguga

SEQ ID NO: 8600 - RNA, 19 nt, Artificial Sequence
  Description of Artificial Sequence: Synthetic oligonucleotide
uccgagagcagcgcaagug

SEQ ID NO: 8601 - RNA, 19 nt, Artificial Sequence
  Description of Artificial Sequence: Synthetic oligonucleotide
cuccgagagcagcgcaagu

SEQ ID NO: 8602 - RNA, 19 nt, Artificial Sequence
  Description of Artificial Sequence: Synthetic oligonucleotide
gcuccgagagcagcgcaag

SEQ ID NO: 8603 - RNA, 19 nt, Artificial Sequence
  Description of Artificial Sequence: Synthetic oligonucleotide
ggcuccgagagcagcgcaa

SEQ ID NO: 8604 - RNA, 19 nt, Artificial Sequence
  Description of Artificial Sequence: Synthetic oligonucleotide
gggcuccgagagcagcgca

SEQ ID NO: 8605 - RNA, 19 nt, Artificial Sequence
  Description of Artificial Sequence: Synthetic oligonucleotide
ggggcuccgagagcagcgc

SEQ ID NO: 8606 - RNA, 19 nt, Artificial Sequence
  Description of Artificial Sequence: Synthetic oligonucleotide
uggggcuccgagagcagcg

SEQ ID NO: 8607 - RNA, 19 nt, Artificial Sequence
  Description of Artificial Sequence: Synthetic oligonucleotide
cuggggcuccgagagcagc

SEQ ID NO: 8608 - RNA, 19 nt, Artificial Sequence
  Description of Artificial Sequence: Synthetic oligonucleotide
gcuggggcuccgagagcag

SEQ ID NO: 8609 - RNA, 19 nt, Artificial Sequence
  Description of Artificial Sequence: Synthetic oligonucleotide
ggcuggggcuccgagagca

SEQ ID NO: 8610 - RNA, 19 nt, Artificial Sequence
  Description of Artificial Sequence: Synthetic oligonucleotide
cggcuggggcuccgagagc

SEQ ID NO: 8611 - RNA, 19 nt, Artificial Sequence
  Description of Artificial Sequence: Synthetic oligonucleotide
ccggcuggggcuccgagag

SEQ ID NO: 8612 - RNA, 19 nt, Artificial Sequence
  Description of Artificial Sequence: Synthetic oligonucleotide
gccggcuggggcuccgaga

SEQ ID NO: 8613 - RNA, 19 nt, Artificial Sequence
  Description of Artificial Sequence: Synthetic oligonucleotide
agccggcuggggcuccgag

SEQ ID NO: 8614 - RNA, 19 nt, Artificial Sequence
  Description of Artificial Sequence: Synthetic oligonucleotide
gagccggcuggggcuccga

SEQ ID NO: 8615 - RNA, 19 nt, Artificial Sequence
  Description of Artificial Sequence: Synthetic oligonucleotide
ggagccggcuggggcuccg

SEQ ID NO: 8616 - RNA, 19 nt, Artificial Sequence
  Description of Artificial Sequence: Synthetic oligonucleotide
cggagccggcuggggcucc

SEQ ID NO: 8617 - RNA, 19 nt, Artificial Sequence
  Description of Artificial Sequence: Synthetic oligonucleotide
gcggagccggcuggggcuc

SEQ ID NO: 8618 - RNA, 19 nt, Artificial Sequence
  Description of Artificial Sequence: Synthetic oligonucleotide
ggcggagccggcuggggcu

SEQ ID NO: 8619 - RNA, 19 nt, Artificial Sequence
  Description of Artificial Sequence: Synthetic oligonucleotide
gggcggagccggcuggggc

SEQ ID NO: 8620 - RNA, 19 nt, Artificial Sequence
  Description of Artificial Sequence: Synthetic oligonucleotide
cgggcggagccggcugggg

SEQ ID NO: 8621 - RNA, 19 nt, Artificial Sequence
  Description of Artificial Sequence: Synthetic oligonucleotide
gcgggcggagccggcuggg

SEQ ID NO: 8622 - RNA, 19 nt, Artificial Sequence
  Description of Artificial Sequence: Synthetic oligonucleotide
agcgggcggagccggcugg

SEQ ID NO: 8623 - RNA, 19 nt, Artificial Sequence
  Description of Artificial Sequence: Synthetic oligonucleotide
aagcgggcggagccggcug

SEQ ID NO: 8624 - RNA, 19 nt, Artificial Sequence
  Description of Artificial Sequence: Synthetic oligonucleotide
gaagcgggcggagccggcu

SEQ ID NO: 8625 - RNA, 19 nt, Artificial Sequence
  Description of Artificial Sequence: Synthetic oligonucleotide
cgaagcgggcggagccggc

SEQ ID NO: 8626 - RNA, 19 nt, Artificial Sequence
  Description of Artificial Sequence: Synthetic oligonucleotide
ccgaagcgggcggagccgg

SEQ ID NO: 8627 - RNA, 19 nt, Artificial Sequence
  Description of Artificial Sequence: Synthetic oligonucleotide
gccgaagcgggcggagccg

SEQ ID NO: 8628 - RNA, 19 nt, Artificial Sequence
  Description of Artificial Sequence: Synthetic oligonucleotide
cgccgaagcgggcggagcc

SEQ ID NO: 8629 - RNA, 19 nt, Artificial Sequence
  Description of Artificial Sequence: Synthetic oligonucleotide
ccgccgaagcgggcggagc

SEQ ID NO: 8630 - RNA, 19 nt, Artificial Sequence
  Description of Artificial Sequence: Synthetic oligonucleotide
accgccgaagcgggcggag

SEQ ID NO: 8631 - RNA, 19 nt, Artificial Sequence
  Description of Artificial Sequence: Synthetic oligonucleotide
aaccgccgaagcgggcgga

SEQ ID NO: 8632 - RNA, 19 nt, Artificial Sequence
  Description of Artificial Sequence: Synthetic oligonucleotide
aaaccgccgaagcgggcgg

SEQ ID NO: 8633 - RNA, 19 nt, Artificial Sequence
  Description of Artificial Sequence: Synthetic oligonucleotide
caaaccgccgaagcgggcg

SEQ ID NO: 8634 - RNA, 19 nt, Artificial Sequence
  Description of Artificial Sequence: Synthetic oligonucleotide
ccaaaccgccgaagcgggc

SEQ ID NO: 8635 - RNA, 19 nt, Artificial Sequence
  Description of Artificial Sequence: Synthetic oligonucleotide
uccaaaccgccgaagcggg

SEQ ID NO: 8636 - RNA, 19 nt, Artificial Sequence
  Description of Artificial Sequence: Synthetic oligonucleotide
auccaaaccgccgaagcgg

SEQ ID NO: 8637 - RNA, 19 nt, Artificial Sequence
  Description of Artificial Sequence: Synthetic oligonucleotide
uauccaaaccgccgaagcg

SEQ ID NO: 8638 - RNA, 19 nt, Artificial Sequence
  Description of Artificial Sequence: Synthetic oligonucleotide
auauccaaaccgccgaagc

SEQ ID NO: 8639 - RNA, 19 nt, Artificial Sequence
  Description of Artificial Sequence: Synthetic oligonucleotide
aauauccaaaccgccgaag

SEQ ID NO: 8640 - RNA, 19 nt, Artificial Sequence
  Description of Artificial Sequence: Synthetic oligonucleotide
aaauauccaaaccgccgaa

SEQ ID NO: 8641 - RNA, 19 nt, Artificial Sequence
  Description of Artificial Sequence: Synthetic oligonucleotide
uaaauauccaaaccgccga

SEQ ID NO: 8642 - RNA, 19 nt, Artificial Sequence
  Description of Artificial Sequence: Synthetic oligonucleotide
auaaauauccaaaccgccg

SEQ ID NO: 8643 - RNA, 19 nt, Artificial Sequence
  Description of Artificial Sequence: Synthetic oligonucleotide
aauaaauauccaaaccgcc

SEQ ID NO: 8644 - RNA, 19 nt, Artificial Sequence
  Description of Artificial Sequence: Synthetic oligonucleotide
caauaaauauccaaaccgc

SEQ ID NO: 8645 - RNA, 19 nt, Artificial Sequence
  Description of Artificial Sequence: Synthetic oligonucleotide
ucaauaaauauccaaaccg

SEQ ID NO: 8646 - RNA, 19 nt, Artificial Sequence
  Description of Artificial Sequence: Synthetic oligonucleotide
gucaauaaauauccaaacc

SEQ ID NO: 8647 - RNA, 19 nt, Artificial Sequence
  Description of Artificial Sequence: Synthetic oligonucleotide
ggucaauaaauauccaaac

SEQ ID NO: 8648 - RNA, 19 nt, Artificial Sequence
  Description of Artificial Sequence: Synthetic oligonucleotide
aggucaauaaauauccaaa

SEQ ID NO: 8649 - RNA, 19 nt, Artificial Sequence
  Description of Artificial Sequence: Synthetic oligonucleotide
gaggucaauaaauauccaa

SEQ ID NO: 8650 - RNA, 19 nt, Artificial Sequence
  Description of Artificial Sequence: Synthetic oligonucleotide
cgaggucaauaaauaucca

SEQ ID NO: 8651 - RNA, 19 nt, Artificial Sequence
  Description of Artificial Sequence: Synthetic oligonucleotide
acgaggucaauaaauaucc

SEQ ID NO: 8652 - RNA, 19 nt, Artificial Sequence
  Description of Artificial Sequence: Synthetic oligonucleotide
gacgaggucaauaaauauc

SEQ ID NO: 8653 - RNA, 19 nt, Artificial Sequence
  Description of Artificial Sequence: Synthetic oligonucleotide
ggacgaggucaauaaauau

SEQ ID NO: 8654 - RNA, 19 nt, Artificial Sequence
  Description of Artificial Sequence: Synthetic oligonucleotide
aggacgaggucaauaaaua

SEQ ID NO: 8655 - RNA, 19 nt, Artificial Sequence
  Description of Artificial Sequence: Synthetic oligonucleotide
gaggacgaggucaauaaau

SEQ ID NO: 8656 - RNA, 19 nt, Artificial Sequence
  Description of Artificial Sequence: Synthetic oligonucleotide
ggaggacgaggucaauaaa

SEQ ID NO: 8657 - RNA, 19 nt, Artificial Sequence
  Description of Artificial Sequence: Synthetic oligonucleotide
cggaggacgaggucaauaa

SEQ ID NO: 8658 - RNA, 19 nt, Artificial Sequence
  Description of Artificial Sequence: Synthetic oligonucleotide
ucggaggacgaggucaaua

SEQ ID NO: 8659 - RNA, 19 nt, Artificial Sequence
  Description of Artificial Sequence: Synthetic oligonucleotide
gucggaggacgaggucaau

SEQ ID NO: 8660 - RNA, 19 nt, Artificial Sequence
  Description of Artificial Sequence: Synthetic oligonucleotide
agucggaggacgaggucaa

SEQ ID NO: 8661 - RNA, 19 nt, Artificial Sequence
  Description of Artificial Sequence: Synthetic oligonucleotide
gagucggaggacgagguca

SEQ ID NO: 8662 - RNA, 19 nt, Artificial Sequence
  Description of Artificial Sequence: Synthetic oligonucleotide
cgagucggaggacgagguc

SEQ ID NO: 8663 - RNA, 19 nt, Artificial Sequence
  Description of Artificial Sequence: Synthetic oligonucleotide
gcgagucggaggacgaggu

SEQ ID NO: 8664 - RNA, 19 nt, Artificial Sequence
  Description of Artificial Sequence: Synthetic oligonucleotide
agcgagucggaggacgagg

SEQ ID NO: 8665 - RNA, 19 nt, Artificial Sequence
  Description of Artificial Sequence: Synthetic oligonucleotide
cagcgagucggaggacgag

SEQ ID NO: 8666 - RNA, 19 nt, Artificial Sequence
  Description of Artificial Sequence: Synthetic oligonucleotide
ucagcgagucggaggacga

SEQ ID NO: 8667 - RNA, 19 nt, Artificial Sequence
  Description of Artificial Sequence: Synthetic oligonucleotide
gucagcgagucggaggacg

SEQ ID NO: 8668 - RNA, 19 nt, Artificial Sequence
  Description of Artificial Sequence: Synthetic oligonucleotide
ugucagcgagucggaggac

SEQ ID NO: 8669 - RNA, 19 nt, Artificial Sequence
  Description of Artificial Sequence: Synthetic oligonucleotide
cugucagcgagucggagga

SEQ ID NO: 8670 - RNA, 19 nt, Artificial Sequence
  Description of Artificial Sequence: Synthetic oligonucleotide
ccugucagcgagucggagg

SEQ ID NO: 8671 - RNA, 19 nt, Artificial Sequence
  Description of Artificial Sequence: Synthetic oligonucleotide
gccugucagcgagucggag

SEQ ID NO: 8672 - RNA, 19 nt, Artificial Sequence
  Description of Artificial Sequence: Synthetic oligonucleotide
agccugucagcgagucgga

SEQ ID NO: 8673 - RNA, 19 nt, Artificial Sequence
  Description of Artificial Sequence: Synthetic oligonucleotide
uagccugucagcgagucgg

SEQ ID NO: 8674 - RNA, 19 nt, Artificial Sequence
  Description of Artificial Sequence: Synthetic oligonucleotide
guagccugucagcgagucg

SEQ ID NO: 8675 - RNA, 19 nt, Artificial Sequence
  Description of Artificial Sequence: Synthetic oligonucleotide
uguagccugucagcgaguc

SEQ ID NO: 8676 - RNA, 19 nt, Artificial Sequence
  Description of Artificial Sequence: Synthetic oligonucleotide
cuguagccugucagcgagu

SEQ ID NO: 8677 - RNA, 19 nt, Artificial Sequence
  Description of Artificial Sequence: Synthetic oligonucleotide
ccuguagccugucagcgag

SEQ ID NO: 8678 - RNA, 19 nt, Artificial Sequence
  Description of Artificial Sequence: Synthetic oligonucleotide
uccuguagccugucagcga

SEQ ID NO: 8679 - RNA, 19 nt, Artificial Sequence
  Description of Artificial Sequence: Synthetic oligonucleotide
guccuguagccugucagcg

SEQ ID NO: 8680 - RNA, 19 nt, Artificial Sequence
  Description of Artificial Sequence: Synthetic oligonucleotide
gguccuguagccugucagc

SEQ ID NO: 8681 - RNA, 19 nt, Artificial Sequence
  Description of Artificial Sequence: Synthetic oligonucleotide
ggguccuguagccugucag

SEQ ID NO: 8682 - RNA, 19 nt, Artificial Sequence
  Description of Artificial Sequence: Synthetic oligonucleotide
gggguccuguagccuguca

SEQ ID NO: 8683 - RNA, 19 nt, Artificial Sequence
  Description of Artificial Sequence: Synthetic oligonucleotide
ggggguccuguagccuguc

SEQ ID NO: 8684 - RNA, 19 nt, Artificial Sequence
  Description of Artificial Sequence: Synthetic oligonucleotide
uggggguccuguagccugu

SEQ ID NO: 8685 - RNA, 19 nt, Artificial Sequence
  Description of Artificial Sequence: Synthetic oligonucleotide
uuggggguccuguagccug

SEQ ID NO: 8686 - RNA, 19 nt, Artificial Sequence
  Description of Artificial Sequence: Synthetic oligonucleotide
guuggggguccuguagccu

SEQ ID NO: 8687 - RNA, 19 nt, Artificial Sequence
  Description of Artificial Sequence: Synthetic oligonucleotide
uguuggggguccuguagcc

SEQ ID NO: 8688 - RNA, 19 nt, Artificial Sequence
  Description of Artificial Sequence: Synthetic oligonucleotide
uuguuggggguccuguagc

SEQ ID NO: 8689 - RNA, 19 nt, Artificial Sequence
  Description of Artificial Sequence: Synthetic oligonucleotide
guuguuggggguccuguag

SEQ ID NO: 8690 - RNA, 19 nt, Artificial Sequence
  Description of Artificial Sequence: Synthetic oligonucleotide
gguuguuggggguccugua

SEQ ID NO: 8691 - RNA, 19 nt, Artificial Sequence
  Description of Artificial Sequence: Synthetic oligonucleotide
ggguuguuggggguccugu

SEQ ID NO: 8692 - RNA, 19 nt, Artificial Sequence
  Description of Artificial Sequence: Synthetic oligonucleotide
gggguuguuggggguccug

SEQ ID NO: 8693 - RNA, 19 nt, Artificial Sequence
  Description of Artificial Sequence: Synthetic oligonucleotide
ugggguuguuggggguccu

SEQ ID NO: 8694 - RNA, 19 nt, Artificial Sequence
  Description of Artificial Sequence: Synthetic oligonucleotide
uugggguuguugggggucc

SEQ ID NO: 8695 - RNA, 19 nt, Artificial Sequence
  Description of Artificial Sequence: Synthetic oligonucleotide
auugggguuguuggggguc

SEQ ID NO: 8696 - RNA, 19 nt, Artificial Sequence
  Description of Artificial Sequence: Synthetic oligonucleotide
gauugggguuguugggggu

SEQ ID NO: 8697 - RNA, 19 nt, Artificial Sequence
  Description of Artificial Sequence: Synthetic oligonucleotide
ggauugggguuguuggggg

SEQ ID NO: 8698 - RNA, 19 nt, Artificial Sequence
  Description of Artificial Sequence: Synthetic oligonucleotide
uggauugggguuguugggg

SEQ ID NO: 8699 - RNA, 19 nt, Artificial Sequence
  Description of Artificial Sequence: Synthetic oligonucleotide
guggauugggguuguuggg

SEQ ID NO: 8700 - RNA, 19 nt, Artificial Sequence
  Description of Artificial Sequence: Synthetic oligonucleotide
cguggauugggguuguugg

SEQ ID NO: 8701 - RNA, 19 nt, Artificial Sequence
  Description of Artificial Sequence: Synthetic oligonucleotide
acguggauugggguuguug

SEQ ID NO: 8702 - RNA, 19 nt, Artificial Sequence
  Description of Artificial Sequence: Synthetic oligonucleotide
aacguggauugggguuguu

SEQ ID NO: 8703 - RNA, 19 nt, Artificial Sequence
  Description of Artificial Sequence: Synthetic oligonucleotide
aaacguggauugggguugu

SEQ ID NO: 8704 - RNA, 19 nt, Artificial Sequence
  Description of Artificial Sequence: Synthetic oligonucleotide
aaaacguggauugggguug

SEQ ID NO: 8705 - RNA, 19 nt, Artificial Sequence
  Description of Artificial Sequence: Synthetic oligonucleotide
caaaacguggauugggguu

SEQ ID NO: 8706 - RNA, 19 nt, Artificial Sequence
  Description of Artificial Sequence: Synthetic oligonucleotide
ccaaaacguggauuggggu

SEQ ID NO: 8707 - RNA, 19 nt, Artificial Sequence
  Description of Artificial Sequence: Synthetic oligonucleotide
uccaaaacguggauugggg

SEQ ID NO: 8708 - RNA, 19 nt, Artificial Sequence
  Description of Artificial Sequence: Synthetic oligonucleotide
auccaaaacguggauuggg

SEQ ID NO: 8709 - RNA, 19 nt, Artificial Sequence
  Description of Artificial Sequence: Synthetic oligonucleotide
cauccaaaacguggauugg

SEQ ID NO: 8710 - RNA, 19 nt, Artificial Sequence
  Description of Artificial Sequence: Synthetic oligonucleotide
gcauccaaaacguggauug

SEQ ID NO: 8711 - RNA, 19 nt, Artificial Sequence
  Description of Artificial Sequence: Synthetic oligonucleotide
ugcauccaaaacguggauu

SEQ ID NO: 8712 - RNA, 19 nt, Artificial Sequence
  Description of Artificial Sequence: Synthetic oligonucleotide
gugcauccaaaacguggau

SEQ ID NO: 8713 - RNA, 19 nt, Artificial Sequence
  Description of Artificial Sequence: Synthetic oligonucleotide
agugcauccaaaacgugga

SEQ ID NO: 8714 - RNA, 19 nt, Artificial Sequence
  Description of Artificial Sequence: Synthetic oligonucleotide
cagugcauccaaaacgugg

SEQ ID NO: 8715 - RNA, 19 nt, Artificial Sequence
  Description of Artificial Sequence: Synthetic oligonucleotide
ucagugcauccaaaacgug

SEQ ID NO: 8716 - RNA, 19 nt, Artificial Sequence
  Description of Artificial Sequence: Synthetic oligonucleotide
cucagugcauccaaaacgu

SEQ ID NO: 8717 - RNA, 19 nt, Artificial Sequence
  Description of Artificial Sequence: Synthetic oligonucleotide
ucucagugcauccaaaacg

SEQ ID NO: 8718 - RNA, 19 nt, Artificial Sequence
  Description of Artificial Sequence: Synthetic oligonucleotide
gucucagugcauccaaaac

SEQ ID NO: 8719 - RNA, 19 nt, Artificial Sequence
  Description of Artificial Sequence: Synthetic oligonucleotide
ggucucagugcauccaaaa

SEQ ID NO: 8720 - RNA, 19 nt, Artificial Sequence
  Description of Artificial Sequence: Synthetic oligonucleotide
gggucucagugcauccaaa

SEQ ID NO: 8721 - RNA, 19 nt, Artificial Sequence
  Description of Artificial Sequence: Synthetic oligonucleotide
ggggucucagugcauccaa

SEQ ID NO: 8722 - RNA, 19 nt, Artificial Sequence
  Description of Artificial Sequence: Synthetic oligonucleotide
cggggucucagugcaucca

SEQ ID NO: 8723 - RNA, 19 nt, Artificial Sequence
  Description of Artificial Sequence: Synthetic oligonucleotide
ucggggucucagugcaucc

SEQ ID NO: 8724 - RNA, 19 nt, Artificial Sequence
  Description of Artificial Sequence: Synthetic oligonucleotide
gucggggucucagugcauc

SEQ ID NO: 8725 - RNA, 19 nt, Artificial Sequence
  Description of Artificial Sequence: Synthetic oligonucleotide
ugucggggucucagugcau

SEQ ID NO: 8726 - RNA, 19 nt, Artificial Sequence
  Description of Artificial Sequence: Synthetic oligonucleotide
augucggggucucagugca

SEQ ID NO: 8727 - RNA, 19 nt, Artificial Sequence
  Description of Artificial Sequence: Synthetic oligonucleotide
aaugucggggucucagugc

SEQ ID NO: 8728 - RNA, 19 nt, Artificial Sequence
  Description of Artificial Sequence: Synthetic oligonucleotide
gaaugucggggucucagug

SEQ ID NO: 8729 - RNA, 19 nt, Artificial Sequence
  Description of Artificial Sequence: Synthetic oligonucleotide
ggaaugucggggucucagu

SEQ ID NO: 8730 - RNA, 19 nt, Artificial Sequence
  Description of Artificial Sequence: Synthetic oligonucleotide
aggaaugucggggucucag

SEQ ID NO: 8731 - RNA, 19 nt, Artificial Sequence
  Description of Artificial Sequence: Synthetic oligonucleotide
gaggaaugucggggucuca

SEQ ID NO: 8732 - RNA, 19 nt, Artificial Sequence
  Description of Artificial Sequence: Synthetic oligonucleotide
cgaggaaugucggggucuc

SEQ ID NO: 8733 - RNA, 19 nt, Artificial Sequence
  Description of Artificial Sequence: Synthetic oligonucleotide
ccgaggaaugucggggucu

SEQ ID NO: 8734 - RNA, 19 nt, Artificial Sequence
  Description of Artificial Sequence: Synthetic oligonucleotide
accgaggaaugucgggguc

SEQ ID NO: 8735 - RNA, 19 nt, Artificial Sequence
  Description of Artificial Sequence: Synthetic oligonucleotide
uaccgaggaaugucggggu

SEQ ID NO: 8736 - RNA, 19 nt, Artificial Sequence
  Description of Artificial Sequence: Synthetic oligonucleotide
auaccgaggaaugucgggg

SEQ ID NO: 8737 - RNA, 19 nt, Artificial Sequence
  Description of Artificial Sequence: Synthetic oligonucleotide
aauaccgaggaaugucggg

SEQ ID NO: 8738 - RNA, 19 nt, Artificial Sequence
  Description of Artificial Sequence: Synthetic oligonucleotide
aaauaccgaggaaugucgg

SEQ ID NO: 8739 - RNA, 19 nt, Artificial Sequence
  Description of Artificial Sequence: Synthetic oligonucleotide
uaaauaccgaggaaugucg

SEQ ID NO: 8740 - RNA, 19 nt, Artificial Sequence
  Description of Artificial Sequence: Synthetic oligonucleotide
auaaauaccgaggaauguc

SEQ ID NO: 8741 - RNA, 19 nt, Artificial Sequence
  Description of Artificial Sequence: Synthetic oligonucleotide
aauaaauaccgaggaaugu

SEQ ID NO: 8742 - RNA, 19 nt, Artificial Sequence
  Description of Artificial Sequence: Synthetic oligonucleotide
caauaaauaccgaggaaug

SEQ ID NO: 8743 - RNA, 19 nt, Artificial Sequence
  Description of Artificial Sequence: Synthetic oligonucleotide
acaauaaauaccgaggaau

SEQ ID NO: 8744 - RNA, 19 nt, Artificial Sequence
  Description of Artificial Sequence: Synthetic oligonucleotide
gacaauaaauaccgaggaa

SEQ ID NO: 8745 - RNA, 19 nt, Artificial Sequence
  Description of Artificial Sequence: Synthetic oligonucleotide
agacaauaaauaccgagga

SEQ ID NO: 8746 - RNA, 19 nt, Artificial Sequence
  Description of Artificial Sequence: Synthetic oligonucleotide
cagacaauaaauaccgagg

SEQ ID NO: 8747 - RNA, 19 nt, Artificial Sequence
  Description of Artificial Sequence: Synthetic oligonucleotide
acagacaauaaauaccgag

SEQ ID NO: 8748 - RNA, 19 nt, Artificial Sequence
  Description of Artificial Sequence: Synthetic oligonucleotide
gacagacaauaaauaccga

SEQ ID NO: 8749 - RNA, 19 nt, Artificial Sequence
  Description of Artificial Sequence: Synthetic oligonucleotide
ggacagacaauaaauaccg

SEQ ID NO: 8750 - RNA, 19 nt, Artificial Sequence
  Description of Artificial Sequence: Synthetic oligonucleotide
gggacagacaauaaauacc

SEQ ID NO: 8751 - RNA, 19 nt, Artificial Sequence
  Description of Artificial Sequence: Synthetic oligonucleotide
ggggacagacaauaaauac

SEQ ID NO: 8752 - RNA, 19 nt, Artificial Sequence
  Description of Artificial Sequence: Synthetic oligonucleotide
uggggacagacaauaaaua

SEQ ID NO: 8753 - RNA, 19 nt, Artificial Sequence
  Description of Artificial Sequence: Synthetic oligonucleotide
guggggacagacaauaaau

SEQ ID NO: 8754 - RNA, 19 nt, Artificial Sequence
  Description of Artificial Sequence: Synthetic oligonucleotide
gguggggacagacaauaaa

SEQ ID NO: 8755 - RNA, 19 nt, Artificial Sequence
  Description of Artificial Sequence: Synthetic oligonucleotide
agguggggacagacaauaa

SEQ ID NO: 8756 - RNA, 19 nt, Artificial Sequence
  Description of Artificial Sequence: Synthetic oligonucleotide
uagguggggacagacaaua

SEQ ID NO: 8757 - RNA, 19 nt, Artificial Sequence
  Description of Artificial Sequence: Synthetic oligonucleotide
cuagguggggacagacaau

SEQ ID NO: 8758 - RNA, 19 nt, Artificial Sequence
  Description of Artificial Sequence: Synthetic oligonucleotide
ccuagguggggacagacaa

SEQ ID NO: 8759 - RNA, 19 nt, Artificial Sequence
  Description of Artificial Sequence: Synthetic oligonucleotide
uccuagguggggacagaca

SEQ ID NO: 8760 - RNA, 19 nt, Artificial Sequence
  Description of Artificial Sequence: Synthetic oligonucleotide
guccuagguggggacagac

SEQ ID NO: 8761 - RNA, 19 nt, Artificial Sequence
  Description of Artificial Sequence: Synthetic oligonucleotide
gguccuagguggggacaga

SEQ ID NO: 8762 - RNA, 19 nt, Artificial Sequence
  Description of Artificial Sequence: Synthetic oligonucleotide
ggguccuagguggggacag

SEQ ID NO: 8763 - RNA, 19 nt, Artificial Sequence
  Description of Artificial Sequence: Synthetic oligonucleotide
gggguccuagguggggaca

SEQ ID NO: 8764 - RNA, 19 nt, Artificial Sequence
  Description of Artificial Sequence: Synthetic oligonucleotide
ggggguccuagguggggac

SEQ ID NO: 8765 - RNA, 19 nt, Artificial Sequence
  Description of Artificial Sequence: Synthetic oligonucleotide
uggggguccuaggugggga

SEQ ID NO: 8766 - RNA, 19 nt, Artificial Sequence
  Description of Artificial Sequence: Synthetic oligonucleotide
guggggguccuaggugggg

SEQ ID NO: 8767 - RNA, 19 nt, Artificial Sequence
  Description of Artificial Sequence: Synthetic oligonucleotide
gguggggguccuagguggg

SEQ ID NO: 8768 - RNA, 19 nt, Artificial Sequence
  Description of Artificial Sequence: Synthetic oligonucleotide
ggguggggguccuaggugg

SEQ ID NO: 8769 - RNA, 19 nt, Artificial Sequence
  Description of Artificial Sequence: Synthetic oligonucleotide
gggguggggguccuaggug

SEQ ID NO: 8770 - RNA, 19 nt, Artificial Sequence
  Description of Artificial Sequence: Synthetic oligonucleotide
ggggguggggguccuaggu

SEQ ID NO: 8771 - RNA, 19 nt, Artificial Sequence
  Description of Artificial Sequence: Synthetic oligonucleotide
cggggguggggguccuagg

SEQ ID NO: 8772 - RNA, 19 nt, Artificial Sequence
  Description of Artificial Sequence: Synthetic oligonucleotide
ucggggguggggguccuag

SEQ ID NO: 8773 - RNA, 19 nt, Artificial Sequence
  Description of Artificial Sequence: Synthetic oligonucleotide
gucggggguggggguccua

SEQ ID NO: 8774 - RNA, 19 nt, Artificial Sequence
  Description of Artificial Sequence: Synthetic oligonucleotide
ggucggggguggggguccu

SEQ ID NO: 8775 - RNA, 19 nt, Artificial Sequence
  Description of Artificial Sequence: Synthetic oligonucleotide
gggucgggggugggggucc

SEQ ID NO: 8776 - RNA, 19 nt, Artificial Sequence
  Description of Artificial Sequence: Synthetic oligonucleotide
agggucggggguggggguc

SEQ ID NO: 8777 - RNA, 19 nt, Artificial Sequence
  Description of Artificial Sequence: Synthetic oligonucleotide
gagggucgggggugggggu

SEQ ID NO: 8778 - RNA, 19 nt, Artificial Sequence
  Description of Artificial Sequence: Synthetic oligonucleotide
cgagggucggggguggggg

SEQ ID NO: 8779 - RNA, 19 nt, Artificial Sequence
  Description of Artificial Sequence: Synthetic oligonucleotide
gcgagggucgggggugggg

SEQ ID NO: 8780 - RNA, 19 nt, Artificial Sequence
  Description of Artificial Sequence: Synthetic oligonucleotide
cgcgagggucggggguggg

SEQ ID NO: 8781 - RNA, 19 nt, Artificial Sequence
  Description of Artificial Sequence: Synthetic oligonucleotide
ucgcgagggucgggggugg

SEQ ID NO: 8782 - RNA, 19 nt, Artificial Sequence
  Description of Artificial Sequence: Synthetic oligonucleotide
uucgcgagggucgggggug

SEQ ID NO: 8783 - RNA, 19 nt, Artificial Sequence
  Description of Artificial Sequence: Synthetic oligonucleotide
auucgcgagggucgggggu

SEQ ID NO: 8784 - RNA, 19 nt, Artificial Sequence
  Description of Artificial Sequence: Synthetic oligonucleotide
uauucgcgagggucggggg

SEQ ID NO: 8785 - RNA, 19 nt, Artificial Sequence
  Description of Artificial Sequence: Synthetic oligonucleotide
uuauucgcgagggucgggg

SEQ ID NO: 8786 - RNA, 19 nt, Artificial Sequence
  Description of Artificial Sequence: Synthetic oligonucleotide
uuuauucgcgagggucggg

SEQ ID NO: 8787 - RNA, 19 nt, Artificial Sequence
  Description of Artificial Sequence: Synthetic oligonucleotide
uuuuauucgcgagggucgg

SEQ ID NO: 8788 - RNA, 19 nt, Artificial Sequence
  Description of Artificial Sequence: Synthetic oligonucleotide
cuuuuauucgcgagggucg

SEQ ID NO: 8789 - RNA, 19 nt, Artificial Sequence
  Description of Artificial Sequence: Synthetic oligonucleotide
ccuuuuauucgcgaggguc

SEQ ID NO: 8790 - RNA, 19 nt, Artificial Sequence
  Description of Artificial Sequence: Synthetic oligonucleotide
gccuuuuauucgcgagggu

SEQ ID NO: 8791 - RNA, 19 nt, Artificial Sequence
  Description of Artificial Sequence: Synthetic oligonucleotide
ggccuuuuauucgcgaggg

SEQ ID NO: 8792 - RNA, 19 nt, Artificial Sequence
  Description of Artificial Sequence: Synthetic oligonucleotide
gggccuuuuauucgcgagg

SEQ ID NO: 8793 - RNA, 19 nt, Artificial Sequence
  Description of Artificial Sequence: Synthetic oligonucleotide
agggccuuuuauucgcgag

SEQ ID NO: 8794 - RNA, 19 nt, Artificial Sequence
  Description of Artificial Sequence: Synthetic oligonucleotide
gagggccuuuuauucgcga

SEQ ID NO: 8795 - RNA, 19 nt, Artificial Sequence
  Description of Artificial Sequence: Synthetic oligonucleotide
ggagggccuuuuauucgcg

SEQ ID NO: 8796 - RNA, 19 nt, Artificial Sequence
  Description of Artificial Sequence: Synthetic oligonucleotide
uggagggccuuuuauucgc

SEQ ID NO: 8797 - RNA, 19 nt, Artificial Sequence
  Description of Artificial Sequence: Synthetic oligonucleotide
auggagggccuuuuauucg

SEQ ID NO: 8798 - RNA, 19 nt, Artificial Sequence
  Description of Artificial Sequence: Synthetic oligonucleotide
gauggagggccuuuuauuc

SEQ ID NO: 8799 - RNA, 19 nt, Artificial Sequence
  Description of Artificial Sequence: Synthetic oligonucleotide
agauggagggccuuuuauu

SEQ ID NO: 8800 - RNA, 19 nt, Artificial Sequence
  Description of Artificial Sequence: Synthetic oligonucleotide
cagauggagggccuuuuau

SEQ ID NO: 8801 - RNA, 19 nt, Artificial Sequence
  Description of Artificial Sequence: Synthetic oligonucleotide
gcagauggagggccuuuua

SEQ ID NO: 8802 - RNA, 19 nt, Artificial Sequence
  Description of Artificial Sequence: Synthetic oligonucleotide
ggcagauggagggccuuuu

SEQ ID NO: 8803 - RNA, 19 nt, Artificial Sequence
  Description of Artificial Sequence: Synthetic oligonucleotide
gggcagauggagggccuuu

SEQ ID NO: 8804 - RNA, 19 nt, Artificial Sequence
  Description of Artificial Sequence: Synthetic oligonucleotide
ugggcagauggagggccuu

SEQ ID NO: 8805 - RNA, 19 nt, Artificial Sequence
  Description of Artificial Sequence: Synthetic oligonucleotide
uugggcagauggagggccu

SEQ ID NO: 8806 - RNA, 19 nt, Artificial Sequence
  Description of Artificial Sequence: Synthetic oligonucleotide
uuugggcagauggagggcc

SEQ ID NO: 8807 - RNA, 19 nt, Artificial Sequence
  Description of Artificial Sequence: Synthetic oligonucleotide
cuuugggcagauggagggc

SEQ ID NO: 8808 - RNA, 19 nt, Artificial Sequence
  Description of Artificial Sequence: Synthetic oligonucleotide
gcuuugggcagauggaggg

SEQ ID NO: 8809 - RNA, 19 nt, Artificial Sequence
  Description of Artificial Sequence: Synthetic oligonucleotide
agcuuugggcagauggagg

SEQ ID NO: 8810 - RNA, 19 nt, Artificial Sequence
  Description of Artificial Sequence: Synthetic oligonucleotide
gagcuuugggcagauggag

SEQ ID NO: 8811 - RNA, 19 nt, Artificial Sequence
  Description of Artificial Sequence: Synthetic oligonucleotide
agagcuuugggcagaugga

SEQ ID NO: 8812 - RNA, 19 nt, Artificial Sequence
  Description of Artificial Sequence: Synthetic oligonucleotide
cagagcuuugggcagaugg

SEQ ID NO: 8813 - RNA, 19 nt, Artificial Sequence
  Description of Artificial Sequence: Synthetic oligonucleotide
ccagagcuuugggcagaug

SEQ ID NO: 8814 - RNA, 19 nt, Artificial Sequence
  Description of Artificial Sequence: Synthetic oligonucleotide
uccagagcuuugggcagau

SEQ ID NO: 8815 - RNA, 19 nt, Artificial Sequence
  Description of Artificial Sequence: Synthetic oligonucleotide
aggggggcuggaccaagga

SEQ ID NO: 8816 - RNA, 19 nt, Artificial Sequence
  Description of Artificial Sequence: Synthetic oligonucleotide
ggggggcuggaccaaggga

SEQ ID NO: 8817 - RNA, 19 nt, Artificial Sequence
  Description of Artificial Sequence: Synthetic oligonucleotide
gggggcuggaccaagggga

SEQ ID NO: 8818 - RNA, 19 nt, Artificial Sequence
  Description of Artificial Sequence: Synthetic oligonucleotide
ggggcuggaccaaggggua

SEQ ID NO: 8819 - RNA, 19 nt, Artificial Sequence
  Description of Artificial Sequence: Synthetic oligonucleotide
gggcuggaccaagggguga

SEQ ID NO: 8820 - RNA, 19 nt, Artificial Sequence
  Description of Artificial Sequence: Synthetic oligonucleotide
ggcuggaccaaggggugga

SEQ ID NO: 8821 - RNA, 19 nt, Artificial Sequence
  Description of Artificial Sequence: Synthetic oligonucleotide
gcuggaccaagggguggga

SEQ ID NO: 8822 - RNA, 19 nt, Artificial Sequence
  Description of Artificial Sequence: Synthetic oligonucleotide
cuggaccaaggggugggga

SEQ ID NO: 8823 - RNA, 19 nt, Artificial Sequence
  Description of Artificial Sequence: Synthetic oligonucleotide
uggaccaagggguggggaa

SEQ ID NO: 8824 - RNA, 19 nt, Artificial Sequence
  Description of Artificial Sequence: Synthetic oligonucleotide
ggaccaagggguggggaga

SEQ ID NO: 8825 - RNA, 19 nt, Artificial Sequence
  Description of Artificial Sequence: Synthetic oligonucleotide
gaccaagggguggggagaa

SEQ ID NO: 8826 - RNA, 19 nt, Artificial Sequence
  Description of Artificial Sequence: Synthetic oligonucleotide
accaagggguggggagaaa

SEQ ID NO: 8827 - RNA, 19 nt, Artificial Sequence
  Description of Artificial Sequence: Synthetic oligonucleotide
ccaagggguggggagaaga

SEQ ID NO: 8828 - RNA, 19 nt, Artificial Sequence
  Description of Artificial Sequence: Synthetic oligonucleotide
caagggguggggagaagga

SEQ ID NO: 8829 - RNA, 19 nt, Artificial Sequence
  Description of Artificial Sequence: Synthetic oligonucleotide
aagggguggggagaaggga

SEQ ID NO: 8830 - RNA, 19 nt, Artificial Sequence
  Description of Artificial Sequence: Synthetic oligonucleotide
agggguggggagaagggga

SEQ ID NO: 8831 - RNA, 19 nt, Artificial Sequence
  Description of Artificial Sequence: Synthetic oligonucleotide
gggguggggagaaggggaa

SEQ ID NO: 8832 - RNA, 19 nt, Artificial Sequence
  Description of Artificial Sequence: Synthetic oligonucleotide
ggguggggagaaggggaga

SEQ ID NO: 8833 - RNA, 19 nt, Artificial Sequence
  Description of Artificial Sequence: Synthetic oligonucleotide
gguggggagaaggggagga

SEQ ID NO: 8834 - RNA, 19 nt, Artificial Sequence
  Description of Artificial Sequence: Synthetic oligonucleotide
guggggagaaggggaggaa

SEQ ID NO: 8835 - RNA, 19 nt, Artificial Sequence
  Description of Artificial Sequence: Synthetic oligonucleotide
uggggagaaggggaggaga

SEQ ID NO: 8836 - RNA, 19 nt, Artificial Sequence
  Description of Artificial Sequence: Synthetic oligonucleotide
ggggagaaggggaggagga

SEQ ID NO: 8837 - RNA, 19 nt, Artificial Sequence
  Description of Artificial Sequence: Synthetic oligonucleotide
gggagaaggggaggaggca

SEQ ID NO: 8838 - RNA, 19 nt, Artificial Sequence
  Description of Artificial Sequence: Synthetic oligonucleotide
ggagaaggggaggaggcca

SEQ ID NO: 8839 - RNA, 19 nt, Artificial Sequence
  Description of Artificial Sequence: Synthetic oligonucleotide
gagaaggggaggaggccua

SEQ ID NO: 8840 - RNA, 19 nt, Artificial Sequence
  Description of Artificial Sequence: Synthetic oligonucleotide
agaaggggaggaggccuca

SEQ ID NO: 8841 - RNA, 19 nt, Artificial Sequence
  Description of Artificial Sequence: Synthetic oligonucleotide
gaaggggaggaggccucga

SEQ ID NO: 8842 - RNA, 19 nt, Artificial Sequence
  Description of Artificial Sequence: Synthetic oligonucleotide
aaggggaggaggccucgga

SEQ ID NO: 8843 - RNA, 19 nt, Artificial Sequence
  Description of Artificial Sequence: Synthetic oligonucleotide
aggggaggaggccucggca

SEQ ID NO: 8844 - RNA, 19 nt, Artificial Sequence
  Description of Artificial Sequence: Synthetic oligonucleotide
ggggaggaggccucggcca

SEQ ID NO: 8845 - RNA, 19 nt, Artificial Sequence
  Description of Artificial Sequence: Synthetic oligonucleotide
gggaggaggccucggccga

SEQ ID NO: 8846 - RNA, 19 nt, Artificial Sequence
  Description of Artificial Sequence: Synthetic oligonucleotide
ggaggaggccucggccgga

SEQ ID NO: 8847 - RNA, 19 nt, Artificial Sequence
  Description of Artificial Sequence: Synthetic oligonucleotide
gaggaggccucggccggca

SEQ ID NO: 8848 - RNA, 19 nt, Artificial Sequence
  Description of Artificial Sequence: Synthetic oligonucleotide
aggaggccucggccggcca

SEQ ID NO: 8849 - RNA, 19 nt, Artificial Sequence
  Description of Artificial Sequence: Synthetic oligonucleotide
ggaggccucggccggccga

SEQ ID NO: 8850 - RNA, 19 nt, Artificial Sequence
  Description of Artificial Sequence: Synthetic oligonucleotide
gaggccucggccggccgca

SEQ ID NO: 8851 - RNA, 19 nt, Artificial Sequence
  Description of Artificial Sequence: Synthetic oligonucleotide
aggccucggccggccgcaa

SEQ ID NO: 8852 - RNA, 19 nt, Artificial Sequence
  Description of Artificial Sequence: Synthetic oligonucleotide
ggccucggccggccgcaga

SEQ ID NO: 8853 - RNA, 19 nt, Artificial Sequence
  Description of Artificial Sequence: Synthetic oligonucleotide
gccucggccggccgcagaa

SEQ ID NO: 8854 - RNA, 19 nt, Artificial Sequence
  Description of Artificial Sequence: Synthetic oligonucleotide
ccucggccggccgcagaga

SEQ ID NO: 8855 - RNA, 19 nt, Artificial Sequence
  Description of Artificial Sequence: Synthetic oligonucleotide
cucggccggccgcagagaa

SEQ ID NO: 8856 - RNA, 19 nt, Artificial Sequence
  Description of Artificial Sequence: Synthetic oligonucleotide
ucggccggccgcagagaga

SEQ ID NO: 8857 - RNA, 19 nt, Artificial Sequence
  Description of Artificial Sequence: Synthetic oligonucleotide
cggccggccgcagagagaa

SEQ ID NO: 8858 - RNA, 19 nt, Artificial Sequence
  Description of Artificial Sequence: Synthetic oligonucleotide
ggccggccgcagagagaaa

SEQ ID NO: 8859 - RNA, 19 nt, Artificial Sequence
  Description of Artificial Sequence: Synthetic oligonucleotide
gccggccgcagagagaaga

SEQ ID NO: 8860 - RNA, 19 nt, Artificial Sequence
  Description of Artificial Sequence: Synthetic oligonucleotide
ccggccgcagagagaagua

SEQ ID NO: 8861 - RNA, 19 nt, Artificial Sequence
  Description of Artificial Sequence: Synthetic oligonucleotide
cggccgcagagagaaguga

SEQ ID NO: 8862 - RNA, 19 nt, Artificial Sequence
  Description of Artificial Sequence: Synthetic oligonucleotide
ggccgcagagagaagugga

SEQ ID NO: 8863 - RNA, 19 nt, Artificial Sequence
  Description of Artificial Sequence: Synthetic oligonucleotide
gccgcagagagaaguggca

SEQ ID NO: 8864 - RNA, 19 nt, Artificial Sequence
  Description of Artificial Sequence: Synthetic oligonucleotide
ccgcagagagaaguggcca

SEQ ID NO: 8865 - RNA, 19 nt, Artificial Sequence
  Description of Artificial Sequence: Synthetic oligonucleotide
cgcagagagaaguggccaa

SEQ ID NO: 8866 - RNA, 19 nt, Artificial Sequence
  Description of Artificial Sequence: Synthetic oligonucleotide
gcagagagaaguggccaga

SEQ ID NO: 8867 - RNA, 19 nt, Artificial Sequence
  Description of Artificial Sequence: Synthetic oligonucleotide
cagagagaaguggccagaa

SEQ ID NO: 8868 - RNA, 19 nt, Artificial Sequence
  Description of Artificial Sequence: Synthetic oligonucleotide
agagagaaguggccagaga

SEQ ID NO: 8869 - RNA, 19 nt, Artificial Sequence
  Description of Artificial Sequence: Synthetic oligonucleotide
gagagaaguggccagagaa

SEQ ID NO: 8870 - RNA, 19 nt, Artificial Sequence
  Description of Artificial Sequence: Synthetic oligonucleotide
agagaaguggccagagaga

SEQ ID NO: 8871 - RNA, 19 nt, Artificial Sequence
  Description of Artificial Sequence: Synthetic oligonucleotide
gagaaguggccagagagga

SEQ ID NO: 8872 - RNA, 19 nt, Artificial Sequence
  Description of Artificial Sequence: Synthetic oligonucleotide
agaaguggccagagaggca

SEQ ID NO: 8873 - RNA, 19 nt, Artificial Sequence
  Description of Artificial Sequence: Synthetic oligonucleotide
gaaguggccagagaggcca

SEQ ID NO: 8874 - RNA, 19 nt, Artificial Sequence
  Description of Artificial Sequence: Synthetic oligonucleotide
aaguggccagagaggccca

SEQ ID NO: 8875 - RNA, 19 nt, Artificial Sequence
  Description of Artificial Sequence: Synthetic oligonucleotide
aguggccagagaggcccaa

SEQ ID NO: 8876 - RNA, 19 nt, Artificial Sequence
  Description of Artificial Sequence: Synthetic oligonucleotide
guggccagagaggcccaga

SEQ ID NO: 8877 - RNA, 19 nt, Artificial Sequence
  Description of Artificial Sequence: Synthetic oligonucleotide
uggccagagaggcccagga

SEQ ID NO: 8878 - RNA, 19 nt, Artificial Sequence
  Description of Artificial Sequence: Synthetic oligonucleotide
ggccagagaggcccaggga

SEQ ID NO: 8879 - RNA, 19 nt, Artificial Sequence
  Description of Artificial Sequence: Synthetic oligonucleotide
gccagagaggcccagggga

SEQ ID NO: 8880 - RNA, 19 nt, Artificial Sequence
  Description of Artificial Sequence: Synthetic oligonucleotide
ccagagaggcccaggggaa

SEQ ID NO: 8881 - RNA, 19 nt, Artificial Sequence
  Description of Artificial Sequence: Synthetic oligonucleotide
cagagaggcccaggggaca

SEQ ID NO: 8882 - RNA, 19 nt, Artificial Sequence
  Description of Artificial Sequence: Synthetic oligonucleotide
agagaggcccaggggacaa

SEQ ID NO: 8883 - RNA, 19 nt, Artificial Sequence
  Description of Artificial Sequence: Synthetic oligonucleotide
gagaggcccaggggacaga

SEQ ID NO: 8884 - RNA, 19 nt, Artificial Sequence
  Description of Artificial Sequence: Synthetic oligonucleotide
agaggcccaggggacagca

SEQ ID NO: 8885 - RNA, 19 nt, Artificial Sequence
  Description of Artificial Sequence: Synthetic oligonucleotide
gaggcccaggggacagcca

SEQ ID NO: 8886 - RNA, 19 nt, Artificial Sequence
  Description of Artificial Sequence: Synthetic oligonucleotide
aggcccaggggacagccaa

SEQ ID NO: 8887 - RNA, 19 nt, Artificial Sequence
  Description of Artificial Sequence: Synthetic oligonucleotide
ggcccaggggacagccaga

SEQ ID NO: 8888 - RNA, 19 nt, Artificial Sequence
  Description of Artificial Sequence: Synthetic oligonucleotide
gcccaggggacagccagga

SEQ ID NO: 8889 - RNA, 19 nt, Artificial Sequence
  Description of Artificial Sequence: Synthetic oligonucleotide
cccaggggacagccaggga

SEQ ID NO: 8890 - RNA, 19 nt, Artificial Sequence
  Description of Artificial Sequence: Synthetic oligonucleotide
ccaggggacagccagggaa

SEQ ID NO: 8891 - RNA, 19 nt, Artificial Sequence
  Description of Artificial Sequence: Synthetic oligonucleotide
caggggacagccagggaca

SEQ ID NO: 8892 - RNA, 19 nt, Artificial Sequence
  Description of Artificial Sequence: Synthetic oligonucleotide
aggggacagccagggacaa

SEQ ID NO: 8893 - RNA, 19 nt, Artificial Sequence
  Description of Artificial Sequence: Synthetic oligonucleotide
ggggacagccagggacaga

SEQ ID NO: 8894 - RNA, 19 nt, Artificial Sequence
  Description of Artificial Sequence: Synthetic oligonucleotide
gggacagccagggacagga

SEQ ID NO: 8895 - RNA, 19 nt, Artificial Sequence
  Description of Artificial Sequence: Synthetic oligonucleotide
ggacagccagggacaggca

SEQ ID NO: 8896 - RNA, 19 nt, Artificial Sequence
  Description of Artificial Sequence: Synthetic oligonucleotide
gacagccagggacaggcaa

SEQ ID NO: 8897 - RNA, 19 nt, Artificial Sequence
  Description of Artificial Sequence: Synthetic oligonucleotide
acagccagggacaggcaga

SEQ ID NO: 8898 - RNA, 19 nt, Artificial Sequence
  Description of Artificial Sequence: Synthetic oligonucleotide
cagccagggacaggcagaa

SEQ ID NO: 8899 - RNA, 19 nt, Artificial Sequence
  Description of Artificial Sequence: Synthetic oligonucleotide
agccagggacaggcagaca

SEQ ID NO: 8900 - RNA, 19 nt, Artificial Sequence
  Description of Artificial Sequence: Synthetic oligonucleotide
gccagggacaggcagacaa

SEQ ID NO: 8901 - RNA, 19 nt, Artificial Sequence
  Description of Artificial Sequence: Synthetic oligonucleotide
ccagggacaggcagacaua

SEQ ID NO: 8902 - RNA, 19 nt, Artificial Sequence
  Description of Artificial Sequence: Synthetic oligonucleotide
cagggacaggcagacauga

SEQ ID NO: 8903 - RNA, 19 nt, Artificial Sequence
  Description of Artificial Sequence: Synthetic oligonucleotide
agggacaggcagacaugca

SEQ ID NO: 8904 - RNA, 19 nt, Artificial Sequence
  Description of Artificial Sequence: Synthetic oligonucleotide
gggacaggcagacaugcaa

SEQ ID NO: 8905 - RNA, 19 nt, Artificial Sequence
  Description of Artificial Sequence: Synthetic oligonucleotide
ggacaggcagacaugcaga

SEQ ID NO: 8906 - RNA, 19 nt, Artificial Sequence
  Description of Artificial Sequence: Synthetic oligonucleotide
gacaggcagacaugcagca

SEQ ID NO: 8907 - RNA, 19 nt, Artificial Sequence
  Description of Artificial Sequence: Synthetic oligonucleotide
acaggcagacaugcagcca

SEQ ID NO: 8908 - RNA, 19 nt, Artificial Sequence
  Description of Artificial Sequence: Synthetic oligonucleotide
caggcagacaugcagccaa

SEQ ID NO: 8909 - RNA, 19 nt, Artificial Sequence
  Description of Artificial Sequence: Synthetic oligonucleotide
aggcagacaugcagccaga

SEQ ID NO: 8910 - RNA, 19 nt, Artificial Sequence
  Description of Artificial Sequence: Synthetic oligonucleotide
ggcagacaugcagccagga

SEQ ID NO: 8911 - RNA, 19 nt, Artificial Sequence
  Description of Artificial Sequence: Synthetic oligonucleotide
gcagacaugcagccaggga

SEQ ID NO: 8912 - RNA, 19 nt, Artificial Sequence
  Description of Artificial Sequence: Synthetic oligonucleotide
cagacaugcagccagggca

SEQ ID NO: 8913 - RNA, 19 nt, Artificial Sequence
  Description of Artificial Sequence: Synthetic oligonucleotide
agacaugcagccagggcua

SEQ ID NO: 8914 - RNA, 19 nt, Artificial Sequence
  Description of Artificial Sequence: Synthetic oligonucleotide
gacaugcagccagggcuca

SEQ ID NO: 8915 - RNA, 19 nt, Artificial Sequence
  Description of Artificial Sequence: Synthetic oligonucleotide
acaugcagccagggcucca

SEQ ID NO: 8916 - RNA, 19 nt, Artificial Sequence
  Description of Artificial Sequence: Synthetic oligonucleotide
caugcagccagggcuccaa

SEQ ID NO: 8917 - RNA, 19 nt, Artificial Sequence
  Description of Artificial Sequence: Synthetic oligonucleotide
augcagccagggcuccaga

SEQ ID NO: 8918 - RNA, 19 nt, Artificial Sequence
  Description of Artificial Sequence: Synthetic oligonucleotide
ugcagccagggcuccagga

SEQ ID NO: 8919 - RNA, 19 nt, Artificial Sequence
  Description of Artificial Sequence: Synthetic oligonucleotide
gcagccagggcuccaggga

SEQ ID NO: 8920 - RNA, 19 nt, Artificial Sequence
  Description of Artificial Sequence: Synthetic oligonucleotide
cagccagggcuccagggca

SEQ ID NO: 8921 - RNA, 19 nt, Artificial Sequence
  Description of Artificial Sequence: Synthetic oligonucleotide
agccagggcuccagggcca

SEQ ID NO: 8922 - RNA, 19 nt, Artificial Sequence
  Description of Artificial Sequence: Synthetic oligonucleotide
gccagggcuccagggccua

SEQ ID NO: 8923 - RNA, 19 nt, Artificial Sequence
  Description of Artificial Sequence: Synthetic oligonucleotide
ccagggcuccagggccuga

SEQ ID NO: 8924 - RNA, 19 nt, Artificial Sequence
  Description of Artificial Sequence: Synthetic oligonucleotide
cagggcuccagggccugga

SEQ ID NO: 8925 - RNA, 19 nt, Artificial Sequence
  Description of Artificial Sequence: Synthetic oligonucleotide
agggcuccagggccuggaa

SEQ ID NO: 8926 - RNA, 19 nt, Artificial Sequence
  Description of Artificial Sequence: Synthetic oligonucleotide
gggcuccagggccuggaca

SEQ ID NO: 8927 - RNA, 19 nt, Artificial Sequence
  Description of Artificial Sequence: Synthetic oligonucleotide
ggcuccagggccuggacaa

SEQ ID NO: 8928 - RNA, 19 nt, Artificial Sequence
  Description of Artificial Sequence: Synthetic oligonucleotide
gcuccagggccuggacaga

SEQ ID NO: 8929 - RNA, 19 nt, Artificial Sequence
  Description of Artificial Sequence: Synthetic oligonucleotide
cuccagggccuggacagga

SEQ ID NO: 8930 - RNA, 19 nt, Artificial Sequence
  Description of Artificial Sequence: Synthetic oligonucleotide
uccagggccuggacaggga

SEQ ID NO: 8931 - RNA, 19 nt, Artificial Sequence
  Description of Artificial Sequence: Synthetic oligonucleotide
ccagggccuggacagggga

SEQ ID NO: 8932 - RNA, 19 nt, Artificial Sequence
  Description of Artificial Sequence: Synthetic oligonucleotide
cagggccuggacaggggca

SEQ ID NO: 8933 - RNA, 19 nt, Artificial Sequence
  Description of Artificial Sequence: Synthetic oligonucleotide
agggccuggacaggggcua

SEQ ID NO: 8934 - RNA, 19 nt, Artificial Sequence
  Description of Artificial Sequence: Synthetic oligonucleotide
gggccuggacaggggcuga

SEQ ID NO: 8935 - RNA, 19 nt, Artificial Sequence
  Description of Artificial Sequence: Synthetic oligonucleotide
ggccuggacaggggcugca

SEQ ID NO: 8936 - RNA, 19 nt, Artificial Sequence
  Description of Artificial Sequence: Synthetic oligonucleotide
gccuggacaggggcugcca

SEQ ID NO: 8937 - RNA, 19 nt, Artificial Sequence
  Description of Artificial Sequence: Synthetic oligonucleotide
ccuggacaggggcugccaa

SEQ ID NO: 8938 - RNA, 19 nt, Artificial Sequence
  Description of Artificial Sequence: Synthetic oligonucleotide
cuggacaggggcugccaga

SEQ ID NO: 8939 - RNA, 19 nt, Artificial Sequence
  Description of Artificial Sequence: Synthetic oligonucleotide
uggacaggggcugccagga

SEQ ID NO: 8940 - RNA, 19 nt, Artificial Sequence
  Description of Artificial Sequence: Synthetic oligonucleotide
ggacaggggcugccaggca

SEQ ID NO: 8941 - RNA, 19 nt, Artificial Sequence
  Description of Artificial Sequence: Synthetic oligonucleotide
gacaggggcugccaggcca

SEQ ID NO: 8942 - RNA, 19 nt, Artificial Sequence
  Description of Artificial Sequence: Synthetic oligonucleotide
acaggggcugccaggccca

SEQ ID NO: 8943 - RNA, 19 nt, Artificial Sequence
  Description of Artificial Sequence: Synthetic oligonucleotide
caggggcugccaggcccua

SEQ ID NO: 8944 - RNA, 19 nt, Artificial Sequence
  Description of Artificial Sequence: Synthetic oligonucleotide
aggggcugccaggcccuga

SEQ ID NO: 8945 - RNA, 19 nt, Artificial Sequence
  Description of Artificial Sequence: Synthetic oligonucleotide
ggggcugccaggcccugua

SEQ ID NO: 8946 - RNA, 19 nt, Artificial Sequence
  Description of Artificial Sequence: Synthetic oligonucleotide
gggcugccaggcccuguga

SEQ ID NO: 8947 - RNA, 19 nt, Artificial Sequence
  Description of Artificial Sequence: Synthetic oligonucleotide
ggcugccaggcccugugaa

SEQ ID NO: 8948 - RNA, 19 nt, Artificial Sequence
  Description of Artificial Sequence: Synthetic oligonucleotide
gcugccaggcccugugaca

SEQ ID NO: 8949 - RNA, 19 nt, Artificial Sequence
  Description of Artificial Sequence: Synthetic oligonucleotide
cugccaggcccugugacaa

SEQ ID NO: 8950 - RNA, 19 nt, Artificial Sequence
  Description of Artificial Sequence: Synthetic oligonucleotide
ugccaggcccugugacaga

SEQ ID NO: 8951 - RNA, 19 nt, Artificial Sequence
  Description of Artificial Sequence: Synthetic oligonucleotide
gccaggcccugugacagga

SEQ ID NO: 8952 - RNA, 19 nt, Artificial Sequence
  Description of Artificial Sequence: Synthetic oligonucleotide
ccaggcccugugacaggaa

SEQ ID NO: 8953 - RNA, 19 nt, Artificial Sequence
  Description of Artificial Sequence: Synthetic oligonucleotide
caggcccugugacaggaga

SEQ ID NO: 8954 - RNA, 19 nt, Artificial Sequence
  Description of Artificial Sequence: Synthetic oligonucleotide
aggcccugugacaggagga

SEQ ID NO: 8955 - RNA, 19 nt, Artificial Sequence
  Description of Artificial Sequence: Synthetic oligonucleotide
ggcccugugacaggaggaa

SEQ ID NO: 8956 - RNA, 19 nt, Artificial Sequence
  Description of Artificial Sequence: Synthetic oligonucleotide
gcccugugacaggaggaca

SEQ ID NO: 8957 - RNA, 19 nt, Artificial Sequence
  Description of Artificial Sequence: Synthetic oligonucleotide
cccugugacaggaggacca

SEQ ID NO: 8958 - RNA, 19 nt, Artificial Sequence
  Description of Artificial Sequence: Synthetic oligonucleotide
ccugugacaggaggaccca

SEQ ID NO: 8959 - RNA, 19 nt, Artificial Sequence
  Description of Artificial Sequence: Synthetic oligonucleotide
cugugacaggaggacccca

SEQ ID NO: 8960 - RNA, 19 nt, Artificial Sequence
  Description of Artificial Sequence: Synthetic oligonucleotide
ugugacaggaggaccccga

SEQ ID NO: 8961 - RNA, 19 nt, Artificial Sequence
  Description of Artificial Sequence: Synthetic oligonucleotide
gugacaggaggaccccgaa

SEQ ID NO: 8962 - RNA, 19 nt, Artificial Sequence
  Description of Artificial Sequence: Synthetic oligonucleotide
ugacaggaggaccccgaga

SEQ ID NO: 8963 - RNA, 19 nt, Artificial Sequence
  Description of Artificial Sequence: Synthetic oligonucleotide
gacaggaggaccccgagca

SEQ ID NO: 8964 - RNA, 19 nt, Artificial Sequence
  Description of Artificial Sequence: Synthetic oligonucleotide
acaggaggaccccgagcca

SEQ ID NO: 8965 - RNA, 19 nt, Artificial Sequence
  Description of Artificial Sequence: Synthetic oligonucleotide
caggaggaccccgagccca

SEQ ID NO: 8966 - RNA, 19 nt, Artificial Sequence
  Description of Artificial Sequence: Synthetic oligonucleotide
aggaggaccccgagcccca

SEQ ID NO: 8967 - RNA, 19 nt, Artificial Sequence
  Description of Artificial Sequence: Synthetic oligonucleotide
ggaggaccccgagccccca

SEQ ID NO: 8968 - RNA, 19 nt, Artificial Sequence
  Description of Artificial Sequence: Synthetic oligonucleotide
gaggaccccgagcccccga

SEQ ID NO: 8969 - RNA, 19 nt, Artificial Sequence
  Description of Artificial Sequence: Synthetic oligonucleotide
aggaccccgagcccccgga

SEQ ID NO: 8970 - RNA, 19 nt, Artificial Sequence
  Description of Artificial Sequence: Synthetic oligonucleotide
ggaccccgagcccccggca

SEQ ID NO: 8971 - RNA, 19 nt, Artificial Sequence
  Description of Artificial Sequence: Synthetic oligonucleotide
gaccccgagcccccggcca

SEQ ID NO: 8972 - RNA, 19 nt, Artificial Sequence
  Description of Artificial Sequence: Synthetic oligonucleotide
accccgagcccccggccca

SEQ ID NO: 8973 - RNA, 19 nt, Artificial Sequence
  Description of Artificial Sequence: Synthetic oligonucleotide
ccccgagcccccggcccga

SEQ ID NO: 8974 - RNA, 19 nt, Artificial Sequence
  Description of Artificial Sequence: Synthetic oligonucleotide
cccgagcccccggcccgga

SEQ ID NO: 8975 - RNA, 19 nt, Artificial Sequence
  Description of Artificial Sequence: Synthetic oligonucleotide
ccgagcccccggcccggga

SEQ ID NO: 8976 - RNA, 19 nt, Artificial Sequence
  Description of Artificial Sequence: Synthetic oligonucleotide
cgagcccccggcccgggga

SEQ ID NO: 8977 - RNA, 19 nt, Artificial Sequence
  Description of Artificial Sequence: Synthetic oligonucleotide
gagcccccggcccggggaa

SEQ ID NO: 8978 - RNA, 19 nt, Artificial Sequence
  Description of Artificial Sequence: Synthetic oligonucleotide
agcccccggcccggggaga

SEQ ID NO: 8979 - RNA, 19 nt, Artificial Sequence
  Description of Artificial Sequence: Synthetic oligonucleotide
gcccccggcccggggagga

SEQ ID NO: 8980 - RNA, 19 nt, Artificial Sequence
  Description of Artificial Sequence: Synthetic oligonucleotide
cccccggcccggggaggga

SEQ ID NO: 8981 - RNA, 19 nt, Artificial Sequence
  Description of Artificial Sequence: Synthetic oligonucleotide
ccccggcccggggagggga

SEQ ID NO: 8982 - RNA, 19 nt, Artificial Sequence
  Description of Artificial Sequence: Synthetic oligonucleotide
cccggcccggggaggggca

SEQ ID NO: 8983 - RNA, 19 nt, Artificial Sequence
  Description of Artificial Sequence: Synthetic oligonucleotide
ccggcccggggaggggcca

SEQ ID NO: 8984 - RNA, 19 nt, Artificial Sequence
  Description of Artificial Sequence: Synthetic oligonucleotide
cggcccggggaggggccaa

SEQ ID NO: 8985 - RNA, 19 nt, Artificial Sequence
  Description of Artificial Sequence: Synthetic oligonucleotide
ggcccggggaggggccaua

SEQ ID NO: 8986 - RNA, 19 nt, Artificial Sequence
  Description of Artificial Sequence: Synthetic oligonucleotide
gcccggggaggggccauga

SEQ ID NO: 8987 - RNA, 19 nt, Artificial Sequence
  Description of Artificial Sequence: Synthetic oligonucleotide
cccggggaggggccaugga

SEQ ID NO: 8988 - RNA, 19 nt, Artificial Sequence
  Description of Artificial Sequence: Synthetic oligonucleotide
ccggggaggggccauggua

SEQ ID NO: 8989 - RNA, 19 nt, Artificial Sequence
  Description of Artificial Sequence: Synthetic oligonucleotide
cggggaggggccaugguga

SEQ ID NO: 8990 - RNA, 19 nt, Artificial Sequence
  Description of Artificial Sequence: Synthetic oligonucleotide
ggggaggggccauggugca

SEQ ID NO: 8991 - RNA, 19 nt, Artificial Sequence
  Description of Artificial Sequence: Synthetic oligonucleotide
gggaggggccauggugcua

SEQ ID NO: 8992 - RNA, 19 nt, Artificial Sequence
  Description of Artificial Sequence: Synthetic oligonucleotide
ggaggggccauggugcuga

SEQ ID NO: 8993 - RNA, 19 nt, Artificial Sequence
  Description of Artificial Sequence: Synthetic oligonucleotide
gaggggccauggugcugca

SEQ ID NO: 8994 - RNA, 19 nt, Artificial Sequence
  Description of Artificial Sequence: Synthetic oligonucleotide
aggggccauggugcugcca

SEQ ID NO: 8995 - RNA, 19 nt, Artificial Sequence
  Description of Artificial Sequence: Synthetic oligonucleotide
ggggccauggugcugccua

SEQ ID NO: 8996 - RNA, 19 nt, Artificial Sequence
  Description of Artificial Sequence: Synthetic oligonucleotide
gggccauggugcugccuga

SEQ ID NO: 8997 - RNA, 19 nt, Artificial Sequence
  Description of Artificial Sequence: Synthetic oligonucleotide
ggccauggugcugccugua

SEQ ID NO: 8998 - RNA, 19 nt, Artificial Sequence
  Description of Artificial Sequence: Synthetic oligonucleotide
gccauggugcugccuguca

SEQ ID NO: 8999 - RNA, 19 nt, Artificial Sequence
  Description of Artificial Sequence: Synthetic oligonucleotide
ccauggugcugccugucca

SEQ ID NO: 9000 - RNA, 19 nt, Artificial Sequence
  Description of Artificial Sequence: Synthetic oligonucleotide
cauggugcugccuguccaa

SEQ ID NO: 9001 - RNA, 19 nt, Artificial Sequence
  Description of Artificial Sequence: Synthetic oligonucleotide
auggugcugccuguccaaa

SEQ ID NO: 9002 - RNA, 19 nt, Artificial Sequence
  Description of Artificial Sequence: Synthetic oligonucleotide
uggugcugccuguccaaca

SEQ ID NO: 9003 - RNA, 19 nt, Artificial Sequence
  Description of Artificial Sequence: Synthetic oligonucleotide
ggugcugccuguccaacaa

SEQ ID NO: 9004 - RNA, 19 nt, Artificial Sequence
  Description of Artificial Sequence: Synthetic oligonucleotide
gugcugccuguccaacaua

SEQ ID NO: 9005 - RNA, 19 nt, Artificial Sequence
  Description of Artificial Sequence: Synthetic oligonucleotide
ugcugccuguccaacauga

SEQ ID NO: 9006 - RNA, 19 nt, Artificial Sequence
  Description of Artificial Sequence: Synthetic oligonucleotide
gcugccuguccaacaugua

SEQ ID NO: 9007 - RNA, 19 nt, Artificial Sequence
  Description of Artificial Sequence: Synthetic oligonucleotide
cugccuguccaacauguca

SEQ ID NO: 9008 - RNA, 19 nt, Artificial Sequence
  Description of Artificial Sequence: Synthetic oligonucleotide
ugccuguccaacaugucaa

SEQ ID NO: 9009 - RNA, 19 nt, Artificial Sequence
  Description of Artificial Sequence: Synthetic oligonucleotide
gccuguccaacaugucaga

SEQ ID NO: 9010 - RNA, 19 nt, Artificial Sequence
  Description of Artificial Sequence: Synthetic oligonucleotide
ccuguccaacaugucagca

SEQ ID NO: 9011 - RNA, 19 nt, Artificial Sequence
  Description of Artificial Sequence: Synthetic oligonucleotide
cuguccaacaugucagcca

SEQ ID NO: 9012 - RNA, 19 nt, Artificial Sequence
  Description of Artificial Sequence: Synthetic oligonucleotide
uguccaacaugucagccga

SEQ ID NO: 9013 - RNA, 19 nt, Artificial Sequence
  Description of Artificial Sequence: Synthetic oligonucleotide
guccaacaugucagccgaa

SEQ ID NO: 9014 - RNA, 19 nt, Artificial Sequence
  Description of Artificial Sequence: Synthetic oligonucleotide
uccaacaugucagccgaga

SEQ ID NO: 9015 - RNA, 19 nt, Artificial Sequence
  Description of Artificial Sequence: Synthetic oligonucleotide
ccaacaugucagccgagga

SEQ ID NO: 9016 - RNA, 19 nt, Artificial Sequence
  Description of Artificial Sequence: Synthetic oligonucleotide
caacaugucagccgaggua

SEQ ID NO: 9017 - RNA, 19 nt, Artificial Sequence
  Description of Artificial Sequence: Synthetic oligonucleotide
aacaugucagccgagguga

SEQ ID NO: 9018 - RNA, 19 nt, Artificial Sequence
  Description of Artificial Sequence: Synthetic oligonucleotide
acaugucagccgaggugca

SEQ ID NO: 9019 - RNA, 19 nt, Artificial Sequence
  Description of Artificial Sequence: Synthetic oligonucleotide
caugucagccgaggugcga

SEQ ID NO: 9020 - RNA, 19 nt, Artificial Sequence
  Description of Artificial Sequence: Synthetic oligonucleotide
augucagccgaggugcgga

SEQ ID NO: 9021 - RNA, 19 nt, Artificial Sequence
  Description of Artificial Sequence: Synthetic oligonucleotide
ugucagccgaggugcggca

SEQ ID NO: 9022 - RNA, 19 nt, Artificial Sequence
  Description of Artificial Sequence: Synthetic oligonucleotide
gucagccgaggugcggcua

SEQ ID NO: 9023 - RNA, 19 nt, Artificial Sequence
  Description of Artificial Sequence: Synthetic oligonucleotide
ucagccgaggugcggcuga

SEQ ID NO: 9024 - RNA, 19 nt, Artificial Sequence
  Description of Artificial Sequence: Synthetic oligonucleotide
cagccgaggugcggcugaa

SEQ ID NO: 9025 - RNA, 19 nt, Artificial Sequence
  Description of Artificial Sequence: Synthetic oligonucleotide
agccgaggugcggcugaga

SEQ ID NO: 9026 - RNA, 19 nt, Artificial Sequence
  Description of Artificial Sequence: Synthetic oligonucleotide
gccgaggugcggcugagga

SEQ ID NO: 9027 - RNA, 19 nt, Artificial Sequence
  Description of Artificial Sequence: Synthetic oligonucleotide
ccgaggugcggcugaggca

SEQ ID NO: 9028 - RNA, 19 nt, Artificial Sequence
  Description of Artificial Sequence: Synthetic oligonucleotide
cgaggugcggcugaggcga

SEQ ID NO: 9029 - RNA, 19 nt, Artificial Sequence
  Description of Artificial Sequence: Synthetic oligonucleotide
gaggugcggcugaggcgga

SEQ ID NO: 9030 - RNA, 19 nt, Artificial Sequence
  Description of Artificial Sequence: Synthetic oligonucleotide
aggugcggcugaggcggca

SEQ ID NO: 9031 - RNA, 19 nt, Artificial Sequence
  Description of Artificial Sequence: Synthetic oligonucleotide
ggugcggcugaggcggcua

SEQ ID NO: 9032 - RNA, 19 nt, Artificial Sequence
  Description of Artificial Sequence: Synthetic oligonucleotide
gugcggcugaggcggcuca

SEQ ID NO: 9033 - RNA, 19 nt, Artificial Sequence
  Description of Artificial Sequence: Synthetic oligonucleotide
ugcggcugaggcggcucca

SEQ ID NO: 9034 - RNA, 19 nt, Artificial Sequence
  Description of Artificial Sequence: Synthetic oligonucleotide
gcggcugaggcggcuccaa

SEQ ID NO: 9035 - RNA, 19 nt, Artificial Sequence
  Description of Artificial Sequence: Synthetic oligonucleotide
cggcugaggcggcuccaga

SEQ ID NO: 9036 - RNA, 19 nt, Artificial Sequence
  Description of Artificial Sequence: Synthetic oligonucleotide
ggcugaggcggcuccagca

SEQ ID NO: 9037 - RNA, 19 nt, Artificial Sequence
  Description of Artificial Sequence: Synthetic oligonucleotide
gcugaggcggcuccagcaa

SEQ ID NO: 9038 - RNA, 19 nt, Artificial Sequence
  Description of Artificial Sequence: Synthetic oligonucleotide
cugaggcggcuccagcaga

SEQ ID NO: 9039 - RNA, 19 nt, Artificial Sequence
  Description of Artificial Sequence: Synthetic oligonucleotide
ugaggcggcuccagcagca

SEQ ID NO: 9040 - RNA, 19 nt, Artificial Sequence
  Description of Artificial Sequence: Synthetic oligonucleotide
gaggcggcuccagcagcua

SEQ ID NO: 9041 - RNA, 19 nt, Artificial Sequence
  Description of Artificial Sequence: Synthetic oligonucleotide
aggcggcuccagcagcuga

SEQ ID NO: 9042 - RNA, 19 nt, Artificial Sequence
  Description of Artificial Sequence: Synthetic oligonucleotide
ggcggcuccagcagcugga

SEQ ID NO: 9043 - RNA, 19 nt, Artificial Sequence
  Description of Artificial Sequence: Synthetic oligonucleotide
gcggcuccagcagcuggua

SEQ ID NO: 9044 - RNA, 19 nt, Artificial Sequence
  Description of Artificial Sequence: Synthetic oligonucleotide
cggcuccagcagcugguga

SEQ ID NO: 9045 - RNA, 19 nt, Artificial Sequence
  Description of Artificial Sequence: Synthetic oligonucleotide
ggcuccagcagcuggugua

SEQ ID NO: 9046 - RNA, 19 nt, Artificial Sequence
  Description of Artificial Sequence: Synthetic oligonucleotide
gcuccagcagcugguguua

SEQ ID NO: 9047 - RNA, 19 nt, Artificial Sequence
  Description of Artificial Sequence: Synthetic oligonucleotide
cuccagcagcugguguuga

SEQ ID NO: 9048 - RNA, 19 nt, Artificial Sequence
  Description of Artificial Sequence: Synthetic oligonucleotide
uccagcagcugguguugga

SEQ ID NO: 9049 - RNA, 19 nt, Artificial Sequence
  Description of Artificial Sequence: Synthetic oligonucleotide
ccagcagcugguguuggaa

SEQ ID NO: 9050 - RNA, 19 nt, Artificial Sequence
  Description of Artificial Sequence: Synthetic oligonucleotide
cagcagcugguguuggaca

SEQ ID NO: 9051 - RNA, 19 nt, Artificial Sequence
  Description of Artificial Sequence: Synthetic oligonucleotide
agcagcugguguuggacca

SEQ ID NO: 9052 - RNA, 19 nt, Artificial Sequence
  Description of Artificial Sequence: Synthetic oligonucleotide
gcagcugguguuggaccca

SEQ ID NO: 9053 - RNA, 19 nt, Artificial Sequence
  Description of Artificial Sequence: Synthetic oligonucleotide
cagcugguguuggacccga

SEQ ID NO: 9054 - RNA, 19 nt, Artificial Sequence
  Description of Artificial Sequence: Synthetic oligonucleotide
agcugguguuggacccgga

SEQ ID NO: 9055 - RNA, 19 nt, Artificial Sequence
  Description of Artificial Sequence: Synthetic oligonucleotide
gcugguguuggacccggga

SEQ ID NO: 9056 - RNA, 19 nt, Artificial Sequence
  Description of Artificial Sequence: Synthetic oligonucleotide
cugguguuggacccgggca

SEQ ID NO: 9057 - RNA, 19 nt, Artificial Sequence
  Description of Artificial Sequence: Synthetic oligonucleotide
ugguguuggacccgggcua

SEQ ID NO: 9058 - RNA, 19 nt, Artificial Sequence
  Description of Artificial Sequence: Synthetic oligonucleotide
gguguuggacccgggcuua

SEQ ID NO: 9059 - RNA, 19 nt, Artificial Sequence
  Description of Artificial Sequence: Synthetic oligonucleotide
guguuggacccgggcuuca

SEQ ID NO: 9060 - RNA, 19 nt, Artificial Sequence
  Description of Artificial Sequence: Synthetic oligonucleotide
uguuggacccgggcuucca

SEQ ID NO: 9061 - RNA, 19 nt, Artificial Sequence
  Description of Artificial Sequence: Synthetic oligonucleotide
guuggacccgggcuuccua

SEQ ID NO: 9062 - RNA, 19 nt, Artificial Sequence
  Description of Artificial Sequence: Synthetic oligonucleotide
uuggacccgggcuuccuga

SEQ ID NO: 9063 - RNA, 19 nt, Artificial Sequence
  Description of Artificial Sequence: Synthetic oligonucleotide
uggacccgggcuuccugga

SEQ ID NO: 9064 - RNA, 19 nt, Artificial Sequence
  Description of Artificial Sequence: Synthetic oligonucleotide
ggacccgggcuuccuggga

SEQ ID NO: 9065 - RNA, 19 nt, Artificial Sequence
  Description of Artificial Sequence: Synthetic oligonucleotide
gacccgggcuuccugggga

SEQ ID NO: 9066 - RNA, 19 nt, Artificial Sequence
  Description of Artificial Sequence: Synthetic oligonucleotide
acccgggcuuccuggggca

SEQ ID NO: 9067 - RNA, 19 nt, Artificial Sequence
  Description of Artificial Sequence: Synthetic oligonucleotide
cccgggcuuccuggggcua

SEQ ID NO: 9068 - RNA, 19 nt, Artificial Sequence
  Description of Artificial Sequence: Synthetic oligonucleotide
ccgggcuuccuggggcuga

SEQ ID NO: 9069 - RNA, 19 nt, Artificial Sequence
  Description of Artificial Sequence: Synthetic oligonucleotide
cgggcuuccuggggcugga

SEQ ID NO: 9070 - RNA, 19 nt, Artificial Sequence
  Description of Artificial Sequence: Synthetic oligonucleotide
gggcuuccuggggcuggaa

SEQ ID NO: 9071 - RNA, 19 nt, Artificial Sequence
  Description of Artificial Sequence: Synthetic oligonucleotide
ggcuuccuggggcuggaga

SEQ ID NO: 9072 - RNA, 19 nt, Artificial Sequence
  Description of Artificial Sequence: Synthetic oligonucleotide
gcuuccuggggcuggagca

SEQ ID NO: 9073 - RNA, 19 nt, Artificial Sequence
  Description of Artificial Sequence: Synthetic oligonucleotide
cuuccuggggcuggagcca

SEQ ID NO: 9074 - RNA, 19 nt, Artificial Sequence
  Description of Artificial Sequence: Synthetic oligonucleotide
uuccuggggcuggagccca

SEQ ID NO: 9075 - RNA, 19 nt, Artificial Sequence
  Description of Artificial Sequence: Synthetic oligonucleotide
uccuggggcuggagcccca

SEQ ID NO: 9076 - RNA, 19 nt, Artificial Sequence
  Description of Artificial Sequence: Synthetic oligonucleotide
ccuggggcuggagccccua

SEQ ID NO: 9077 - RNA, 19 nt, Artificial Sequence
  Description of Artificial Sequence: Synthetic oligonucleotide
cuggggcuggagccccuga

SEQ ID NO: 9078 - RNA, 19 nt, Artificial Sequence
  Description of Artificial Sequence: Synthetic oligonucleotide
uggggcuggagccccugca

SEQ ID NO: 9079 - RNA, 19 nt, Artificial Sequence
  Description of Artificial Sequence: Synthetic oligonucleotide
ggggcuggagccccugcua

SEQ ID NO: 9080 - RNA, 19 nt, Artificial Sequence
  Description of Artificial Sequence: Synthetic oligonucleotide
gggcuggagccccugcuca

SEQ ID NO: 9081 - RNA, 19 nt, Artificial Sequence
  Description of Artificial Sequence: Synthetic oligonucleotide
ggcuggagccccugcucga

SEQ ID NO: 9082 - RNA, 19 nt, Artificial Sequence
  Description of Artificial Sequence: Synthetic oligonucleotide
gcuggagccccugcucgaa

SEQ ID NO: 9083 - RNA, 19 nt, Artificial Sequence
  Description of Artificial Sequence: Synthetic oligonucleotide
cuggagccccugcucgaca

SEQ ID NO: 9084 - RNA, 19 nt, Artificial Sequence
  Description of Artificial Sequence: Synthetic oligonucleotide
uggagccccugcucgacca

SEQ ID NO: 9085 - RNA, 19 nt, Artificial Sequence
  Description of Artificial Sequence: Synthetic oligonucleotide
ggagccccugcucgaccua

SEQ ID NO: 9086 - RNA, 19 nt, Artificial Sequence
  Description of Artificial Sequence: Synthetic oligonucleotide
gagccccugcucgaccuua

SEQ ID NO: 9087 - RNA, 19 nt, Artificial Sequence
  Description of Artificial Sequence: Synthetic oligonucleotide
agccccugcucgaccuuca

SEQ ID NO: 9088 - RNA, 19 nt, Artificial Sequence
  Description of Artificial Sequence: Synthetic oligonucleotide
gccccugcucgaccuucua

SEQ ID NO: 9089 - RNA, 19 nt, Artificial Sequence
  Description of Artificial Sequence: Synthetic oligonucleotide
ccccugcucgaccuucuca

SEQ ID NO: 9090 - RNA, 19 nt, Artificial Sequence
  Description of Artificial Sequence: Synthetic oligonucleotide
cccugcucgaccuucucca

SEQ ID NO: 9091 - RNA, 19 nt, Artificial Sequence
  Description of Artificial Sequence: Synthetic oligonucleotide
ccugcucgaccuucuccua

SEQ ID NO: 9092 - RNA, 19 nt, Artificial Sequence
  Description of Artificial Sequence: Synthetic oligonucleotide
cugcucgaccuucuccuga

SEQ ID NO: 9093 - RNA, 19 nt, Artificial Sequence
  Description of Artificial Sequence: Synthetic oligonucleotide
ugcucgaccuucuccugga

SEQ ID NO: 9094 - RNA, 19 nt, Artificial Sequence
  Description of Artificial Sequence: Synthetic oligonucleotide
gcucgaccuucuccuggga

SEQ ID NO: 9095 - RNA, 19 nt, Artificial Sequence
  Description of Artificial Sequence: Synthetic oligonucleotide
cucgaccuucuccugggca

SEQ ID NO: 9096 - RNA, 19 nt, Artificial Sequence
  Description of Artificial Sequence: Synthetic oligonucleotide
ucgaccuucuccugggcga

SEQ ID NO: 9097 - RNA, 19 nt, Artificial Sequence
  Description of Artificial Sequence: Synthetic oligonucleotide
cgaccuucuccugggcgua

SEQ ID NO: 9098 - RNA, 19 nt, Artificial Sequence
  Description of Artificial Sequence: Synthetic oligonucleotide
gaccuucuccugggcguca

SEQ ID NO: 9099 - RNA, 19 nt, Artificial Sequence
  Description of Artificial Sequence: Synthetic oligonucleotide
accuucuccugggcgucca

SEQ ID NO: 9100 - RNA, 19 nt, Artificial Sequence
  Description of Artificial Sequence: Synthetic oligonucleotide
ccuucuccugggcguccaa

SEQ ID NO: 9101 - RNA, 19 nt, Artificial Sequence
  Description of Artificial Sequence: Synthetic oligonucleotide
cuucuccugggcguccaca

SEQ ID NO: 9102 - RNA, 19 nt, Artificial Sequence
  Description of Artificial Sequence: Synthetic oligonucleotide
uucuccugggcguccacca

SEQ ID NO: 9103 - RNA, 19 nt, Artificial Sequence
  Description of Artificial Sequence: Synthetic oligonucleotide
ucuccugggcguccaccaa

SEQ ID NO: 9104 - RNA, 19 nt, Artificial Sequence
  Description of Artificial Sequence: Synthetic oligonucleotide
cuccugggcguccaccaga

SEQ ID NO: 9105 - RNA, 19 nt, Artificial Sequence
  Description of Artificial Sequence: Synthetic oligonucleotide
uccugggcguccaccagga

SEQ ID NO: 9106 - RNA, 19 nt, Artificial Sequence
  Description of Artificial Sequence: Synthetic oligonucleotide
ccugggcguccaccaggaa

SEQ ID NO: 9107 - RNA, 19 nt, Artificial Sequence
  Description of Artificial Sequence: Synthetic oligonucleotide
cugggcguccaccaggaga

SEQ ID NO: 9108 - RNA, 19 nt, Artificial Sequence
  Description of Artificial Sequence: Synthetic oligonucleotide
ugggcguccaccaggagca

SEQ ID NO: 9109 - RNA, 19 nt, Artificial Sequence
  Description of Artificial Sequence: Synthetic oligonucleotide
gggcguccaccaggagcua

SEQ ID NO: 9110 - RNA, 19 nt, Artificial Sequence
  Description of Artificial Sequence: Synthetic oligonucleotide
ggcguccaccaggagcuga

SEQ ID NO: 9111 - RNA, 19 nt, Artificial Sequence
  Description of Artificial Sequence: Synthetic oligonucleotide
gcguccaccaggagcugga

SEQ ID NO: 9112 - RNA, 19 nt, Artificial Sequence
  Description of Artificial Sequence: Synthetic oligonucleotide
cguccaccaggagcuggga

SEQ ID NO: 9113 - RNA, 19 nt, Artificial Sequence
  Description of Artificial Sequence: Synthetic oligonucleotide
guccaccaggagcugggca

SEQ ID NO: 9114 - RNA, 19 nt, Artificial Sequence
  Description of Artificial Sequence: Synthetic oligonucleotide
uccaccaggagcugggcga

SEQ ID NO: 9115 - RNA, 19 nt, Artificial Sequence
  Description of Artificial Sequence: Synthetic oligonucleotide
ccaccaggagcugggcgca

SEQ ID NO: 9116 - RNA, 19 nt, Artificial Sequence
  Description of Artificial Sequence: Synthetic oligonucleotide
caccaggagcugggcgcca

SEQ ID NO: 9117 - RNA, 19 nt, Artificial Sequence
  Description of Artificial Sequence: Synthetic oligonucleotide
accaggagcugggcgccua

SEQ ID NO: 9118 - RNA, 19 nt, Artificial Sequence
  Description of Artificial Sequence: Synthetic oligonucleotide
ccaggagcugggcgccuca

SEQ ID NO: 9119 - RNA, 19 nt, Artificial Sequence
  Description of Artificial Sequence: Synthetic oligonucleotide
caggagcugggcgccucca

SEQ ID NO: 9120 - RNA, 19 nt, Artificial Sequence
  Description of Artificial Sequence: Synthetic oligonucleotide
aggagcugggcgccuccga

SEQ ID NO: 9121 - RNA, 19 nt, Artificial Sequence
  Description of Artificial Sequence: Synthetic oligonucleotide
ggagcugggcgccuccgaa

SEQ ID NO: 9122 - RNA, 19 nt, Artificial Sequence
  Description of Artificial Sequence: Synthetic oligonucleotide
gagcugggcgccuccgaaa

SEQ ID NO: 9123 - RNA, 19 nt, Artificial Sequence
  Description of Artificial Sequence: Synthetic oligonucleotide
agcugggcgccuccgaaca

SEQ ID NO: 9124 - RNA, 19 nt, Artificial Sequence
  Description of Artificial Sequence: Synthetic oligonucleotide
gcugggcgccuccgaacua

SEQ ID NO: 9125 - RNA, 19 nt, Artificial Sequence
  Description of Artificial Sequence: Synthetic oligonucleotide
cugggcgccuccgaacuga

SEQ ID NO: 9126 - RNA, 19 nt, Artificial Sequence
  Description of Artificial Sequence: Synthetic oligonucleotide
ugggcgccuccgaacugga

SEQ ID NO: 9127 - RNA, 19 nt, Artificial Sequence
  Description of Artificial Sequence: Synthetic oligonucleotide
gggcgccuccgaacuggca

SEQ ID NO: 9128 - RNA, 19 nt, Artificial Sequence
  Description of Artificial Sequence: Synthetic oligonucleotide
ggcgccuccgaacuggcca

SEQ ID NO: 9129 - RNA, 19 nt, Artificial Sequence
  Description of Artificial Sequence: Synthetic oligonucleotide
gcgccuccgaacuggccca

SEQ ID NO: 9130 - RNA, 19 nt, Artificial Sequence
  Description of Artificial Sequence: Synthetic oligonucleotide
cgccuccgaacuggcccaa

SEQ ID NO: 9131 - RNA, 19 nt, Artificial Sequence
  Description of Artificial Sequence: Synthetic oligonucleotide
gccuccgaacuggcccaga

SEQ ID NO: 9132 - RNA, 19 nt, Artificial Sequence
  Description of Artificial Sequence: Synthetic oligonucleotide
ccuccgaacuggcccagga

SEQ ID NO: 9133 - RNA, 19 nt, Artificial Sequence
  Description of Artificial Sequence: Synthetic oligonucleotide
cuccgaacuggcccaggaa

SEQ ID NO: 9134 - RNA, 19 nt, Artificial Sequence
  Description of Artificial Sequence: Synthetic oligonucleotide
uccgaacuggcccaggaca

SEQ ID NO: 9135 - RNA, 19 nt, Artificial Sequence
  Description of Artificial Sequence: Synthetic oligonucleotide
ccgaacuggcccaggacaa

SEQ ID NO: 9136 - RNA, 19 nt, Artificial Sequence
  Description of Artificial Sequence: Synthetic oligonucleotide
cgaacuggcccaggacaaa

SEQ ID NO: 9137 - RNA, 19 nt, Artificial Sequence
  Description of Artificial Sequence: Synthetic oligonucleotide
gaacuggcccaggacaaga

SEQ ID NO: 9138 - RNA, 19 nt, Artificial Sequence
  Description of Artificial Sequence: Synthetic oligonucleotide
aacuggcccaggacaagua

SEQ ID NO: 9139 - RNA, 19 nt, Artificial Sequence
  Description of Artificial Sequence: Synthetic oligonucleotide
acuggcccaggacaaguaa

SEQ ID NO: 9140 - RNA, 19 nt, Artificial Sequence
  Description of Artificial Sequence: Synthetic oligonucleotide
cuggcccaggacaaguaca

SEQ ID NO: 9141 - RNA, 19 nt, Artificial Sequence
  Description of Artificial Sequence: Synthetic oligonucleotide
uggcccaggacaaguacga

SEQ ID NO: 9142 - RNA, 19 nt, Artificial Sequence
  Description of Artificial Sequence: Synthetic oligonucleotide
ggcccaggacaaguacgua

SEQ ID NO: 9143 - RNA, 19 nt, Artificial Sequence
  Description of Artificial Sequence: Synthetic oligonucleotide
gcccaggacaaguacguga

SEQ ID NO: 9144 - RNA, 19 nt, Artificial Sequence
  Description of Artificial Sequence: Synthetic oligonucleotide
cccaggacaaguacgugga

SEQ ID NO: 9145 - RNA, 19 nt, Artificial Sequence
  Description of Artificial Sequence: Synthetic oligonucleotide
ccaggacaaguacguggca

SEQ ID NO: 9146 - RNA, 19 nt, Artificial Sequence
  Description of Artificial Sequence: Synthetic oligonucleotide
caggacaaguacguggcca

SEQ ID NO: 9147 - RNA, 19 nt, Artificial Sequence
  Description of Artificial Sequence: Synthetic oligonucleotide
aggacaaguacguggccga

SEQ ID NO: 9148 - RNA, 19 nt, Artificial Sequence
  Description of Artificial Sequence: Synthetic oligonucleotide
ggacaaguacguggccgaa

SEQ ID NO: 9149 - RNA, 19 nt, Artificial Sequence
  Description of Artificial Sequence: Synthetic oligonucleotide
gacaaguacguggccgaca

SEQ ID NO: 9150 - RNA, 19 nt, Artificial Sequence
  Description of Artificial Sequence: Synthetic oligonucleotide
acaaguacguggccgacua

SEQ ID NO: 9151 - RNA, 19 nt, Artificial Sequence
  Description of Artificial Sequence: Synthetic oligonucleotide
caaguacguggccgacuua

SEQ ID NO: 9152 - RNA, 19 nt, Artificial Sequence
  Description of Artificial Sequence: Synthetic oligonucleotide
aaguacguggccgacuuca

SEQ ID NO: 9153 - RNA, 19 nt, Artificial Sequence
  Description of Artificial Sequence: Synthetic oligonucleotide
aguacguggccgacuucua

SEQ ID NO: 9154 - RNA, 19 nt, Artificial Sequence
  Description of Artificial Sequence: Synthetic oligonucleotide
guacguggccgacuucuua

SEQ ID NO: 9155 - RNA, 19 nt, Artificial Sequence
  Description of Artificial Sequence: Synthetic oligonucleotide
uacguggccgacuucuuga

SEQ ID NO: 9156 - RNA, 19 nt, Artificial Sequence
  Description of Artificial Sequence: Synthetic oligonucleotide
acguggccgacuucuugca

SEQ ID NO: 9157 - RNA, 19 nt, Artificial Sequence
  Description of Artificial Sequence: Synthetic oligonucleotide
cguggccgacuucuugcaa

SEQ ID NO: 9158 - RNA, 19 nt, Artificial Sequence
  Description of Artificial Sequence: Synthetic oligonucleotide
guggccgacuucuugcaga

SEQ ID NO: 9159 - RNA, 19 nt, Artificial Sequence
  Description of Artificial Sequence: Synthetic oligonucleotide
uggccgacuucuugcagua

SEQ ID NO: 9160 - RNA, 19 nt, Artificial Sequence
  Description of Artificial Sequence: Synthetic oligonucleotide
ggccgacuucuugcaguga

SEQ ID NO: 9161 - RNA, 19 nt, Artificial Sequence
  Description of Artificial Sequence: Synthetic oligonucleotide
gccgacuucuugcagugga

SEQ ID NO: 9162 - RNA, 19 nt, Artificial Sequence
  Description of Artificial Sequence: Synthetic oligonucleotide
ccgacuucuugcaguggga

SEQ ID NO: 9163 - RNA, 19 nt, Artificial Sequence
  Description of Artificial Sequence: Synthetic oligonucleotide
cgacuucuugcagugggca

SEQ ID NO: 9164 - RNA, 19 nt, Artificial Sequence
  Description of Artificial Sequence: Synthetic oligonucleotide
gacuucuugcagugggcga

SEQ ID NO: 9165 - RNA, 19 nt, Artificial Sequence
  Description of Artificial Sequence: Synthetic oligonucleotide
acuucuugcagugggcgga

SEQ ID NO: 9166 - RNA, 19 nt, Artificial Sequence
  Description of Artificial Sequence: Synthetic oligonucleotide
cuucuugcagugggcggaa

SEQ ID NO: 9167 - RNA, 19 nt, Artificial Sequence
  Description of Artificial Sequence: Synthetic oligonucleotide
uucuugcagugggcggaga

SEQ ID NO: 9168 - RNA, 19 nt, Artificial Sequence
  Description of Artificial Sequence: Synthetic oligonucleotide
ucuugcagugggcggagca

SEQ ID NO: 9169 - RNA, 19 nt, Artificial Sequence
  Description of Artificial Sequence: Synthetic oligonucleotide
cuugcagugggcggagcca

SEQ ID NO: 9170 - RNA, 19 nt, Artificial Sequence
  Description of Artificial Sequence: Synthetic oligonucleotide
uugcagugggcggagccca

SEQ ID NO: 9171 - RNA, 19 nt, Artificial Sequence
  Description of Artificial Sequence: Synthetic oligonucleotide
ugcagugggcggagcccaa

SEQ ID NO: 9172 - RNA, 19 nt, Artificial Sequence
  Description of Artificial Sequence: Synthetic oligonucleotide
gcagugggcggagcccaua

SEQ ID NO: 9173 - RNA, 19 nt, Artificial Sequence
  Description of Artificial Sequence: Synthetic oligonucleotide
cagugggcggagcccauca

SEQ ID NO: 9174 - RNA, 19 nt, Artificial Sequence
  Description of Artificial Sequence: Synthetic oligonucleotide
agugggcggagcccaucga

SEQ ID NO: 9175 - RNA, 19 nt, Artificial Sequence
  Description of Artificial Sequence: Synthetic oligonucleotide
gugggcggagcccaucgua

SEQ ID NO: 9176 - RNA, 19 nt, Artificial Sequence
  Description of Artificial Sequence: Synthetic oligonucleotide
ugggcggagcccaucguga

SEQ ID NO: 9177 - RNA, 19 nt, Artificial Sequence
  Description of Artificial Sequence: Synthetic oligonucleotide
gggcggagcccaucgugga

SEQ ID NO: 9178 - RNA, 19 nt, Artificial Sequence
  Description of Artificial Sequence: Synthetic oligonucleotide
ggcggagcccaucguggua

SEQ ID NO: 9179 - RNA, 19 nt, Artificial Sequence
  Description of Artificial Sequence: Synthetic oligonucleotide
gcggagcccaucgugguga

SEQ ID NO: 9180 - RNA, 19 nt, Artificial Sequence
  Description of Artificial Sequence: Synthetic oligonucleotide
cggagcccaucguggugaa

SEQ ID NO: 9181 - RNA, 19 nt, Artificial Sequence
  Description of Artificial Sequence: Synthetic oligonucleotide
ggagcccaucguggugaga

SEQ ID NO: 9182 - RNA, 19 nt, Artificial Sequence
  Description of Artificial Sequence: Synthetic oligonucleotide
gagcccaucguggugagga

SEQ ID NO: 9183 - RNA, 19 nt, Artificial Sequence
  Description of Artificial Sequence: Synthetic oligonucleotide
agcccaucguggugaggca

SEQ ID NO: 9184 - RNA, 19 nt, Artificial Sequence
  Description of Artificial Sequence: Synthetic oligonucleotide
gcccaucguggugaggcua

SEQ ID NO: 9185 - RNA, 19 nt, Artificial Sequence
  Description of Artificial Sequence: Synthetic oligonucleotide
cccaucguggugaggcuua

SEQ ID NO: 9186 - RNA, 19 nt, Artificial Sequence
  Description of Artificial Sequence: Synthetic oligonucleotide
ccaucguggugaggcuuaa

SEQ ID NO: 9187 - RNA, 19 nt, Artificial Sequence
  Description of Artificial Sequence: Synthetic oligonucleotide
caucguggugaggcuuaaa

SEQ ID NO: 9188 - RNA, 19 nt, Artificial Sequence
  Description of Artificial Sequence: Synthetic oligonucleotide
aucguggugaggcuuaaga

SEQ ID NO: 9189 - RNA, 19 nt, Artificial Sequence
  Description of Artificial Sequence: Synthetic oligonucleotide
ucguggugaggcuuaagga

SEQ ID NO: 9190 - RNA, 19 nt, Artificial Sequence
  Description of Artificial Sequence: Synthetic oligonucleotide
cguggugaggcuuaaggaa

SEQ ID NO: 9191 - RNA, 19 nt, Artificial Sequence
  Description of Artificial Sequence: Synthetic oligonucleotide
guggugaggcuuaaggaga

SEQ ID NO: 9192 - RNA, 19 nt, Artificial Sequence
  Description of Artificial Sequence: Synthetic oligonucleotide
uggugaggcuuaaggagga

SEQ ID NO: 9193 - RNA, 19 nt, Artificial Sequence
  Description of Artificial Sequence: Synthetic oligonucleotide
ggugaggcuuaaggaggua

SEQ ID NO: 9194 - RNA, 19 nt, Artificial Sequence
  Description of Artificial Sequence: Synthetic oligonucleotide
gugaggcuuaaggagguca

SEQ ID NO: 9195 - RNA, 19 nt, Artificial Sequence
  Description of Artificial Sequence: Synthetic oligonucleotide
ugaggcuuaaggaggucca

SEQ ID NO: 9196 - RNA, 19 nt, Artificial Sequence
  Description of Artificial Sequence: Synthetic oligonucleotide
gaggcuuaaggagguccga

SEQ ID NO: 9197 - RNA, 19 nt, Artificial Sequence
  Description of Artificial Sequence: Synthetic oligonucleotide
aggcuuaaggagguccgaa

SEQ ID NO: 9198 - RNA, 19 nt, Artificial Sequence
  Description of Artificial Sequence: Synthetic oligonucleotide
ggcuuaaggagguccgaca

SEQ ID NO: 9199 - RNA, 19 nt, Artificial Sequence
  Description of Artificial Sequence: Synthetic oligonucleotide
gcuuaaggagguccgacua

SEQ ID NO: 9200 - RNA, 19 nt, Artificial Sequence
  Description of Artificial Sequence: Synthetic oligonucleotide
cuuaaggagguccgacuga

SEQ ID NO: 9201 - RNA, 19 nt, Artificial Sequence
  Description of Artificial Sequence: Synthetic oligonucleotide
uuaaggagguccgacugca

SEQ ID NO: 9202 - RNA, 19 nt, Artificial Sequence
  Description of Artificial Sequence: Synthetic oligonucleotide
uaaggagguccgacugcaa

SEQ ID NO: 9203 - RNA, 19 nt, Artificial Sequence
  Description of Artificial Sequence: Synthetic oligonucleotide
aaggagguccgacugcaga

SEQ ID NO: 9204 - RNA, 19 nt, Artificial Sequence
  Description of Artificial Sequence: Synthetic oligonucleotide
aggagguccgacugcagaa

SEQ ID NO: 9205 - RNA, 19 nt, Artificial Sequence
  Description of Artificial Sequence: Synthetic oligonucleotide
ggagguccgacugcagaga

SEQ ID NO: 9206 - RNA, 19 nt, Artificial Sequence
  Description of Artificial Sequence: Synthetic oligonucleotide
gagguccgacugcagagga

SEQ ID NO: 9207 - RNA, 19 nt, Artificial Sequence
  Description of Artificial Sequence: Synthetic oligonucleotide
agguccgacugcagaggga

SEQ ID NO: 9208 - RNA, 19 nt, Artificial Sequence
  Description of Artificial Sequence: Synthetic oligonucleotide
gguccgacugcagagggaa

SEQ ID NO: 9209 - RNA, 19 nt, Artificial Sequence
  Description of Artificial Sequence: Synthetic oligonucleotide
guccgacugcagagggaca

SEQ ID NO: 9210 - RNA, 19 nt, Artificial Sequence
  Description of Artificial Sequence: Synthetic oligonucleotide
uccgacugcagagggacga

SEQ ID NO: 9211 - RNA, 19 nt, Artificial Sequence
  Description of Artificial Sequence: Synthetic oligonucleotide
ccgacugcagagggacgaa

SEQ ID NO: 9212 - RNA, 19 nt, Artificial Sequence
  Description of Artificial Sequence: Synthetic oligonucleotide
cgacugcagagggacgaca

SEQ ID NO: 9213 - RNA, 19 nt, Artificial Sequence
  Description of Artificial Sequence: Synthetic oligonucleotide
gacugcagagggacgacua

SEQ ID NO: 9214 - RNA, 19 nt, Artificial Sequence
  Description of Artificial Sequence: Synthetic oligonucleotide
acugcagagggacgacuua

SEQ ID NO: 9215 - RNA, 19 nt, Artificial Sequence
  Description of Artificial Sequence: Synthetic oligonucleotide
cugcagagggacgacuuca

SEQ ID NO: 9216 - RNA, 19 nt, Artificial Sequence
  Description of Artificial Sequence: Synthetic oligonucleotide
ugcagagggacgacuucga

SEQ ID NO: 9217 - RNA, 19 nt, Artificial Sequence
  Description of Artificial Sequence: Synthetic oligonucleotide
gcagagggacgacuucgaa

SEQ ID NO: 9218 - RNA, 19 nt, Artificial Sequence
  Description of Artificial Sequence: Synthetic oligonucleotide
cagagggacgacuucgaga

SEQ ID NO: 9219 - RNA, 19 nt, Artificial Sequence
  Description of Artificial Sequence: Synthetic oligonucleotide
agagggacgacuucgagaa

SEQ ID NO: 9220 - RNA, 19 nt, Artificial Sequence
  Description of Artificial Sequence: Synthetic oligonucleotide
gagggacgacuucgagaua

SEQ ID NO: 9221 - RNA, 19 nt, Artificial Sequence
  Description of Artificial Sequence: Synthetic oligonucleotide
agggacgacuucgagauua

SEQ ID NO: 9222 - RNA, 19 nt, Artificial Sequence
  Description of Artificial Sequence: Synthetic oligonucleotide
gggacgacuucgagauuca

SEQ ID NO: 9223 - RNA, 19 nt, Artificial Sequence
  Description of Artificial Sequence: Synthetic oligonucleotide
ggacgacuucgagauucua

SEQ ID NO: 9224 - RNA, 19 nt, Artificial Sequence
  Description of Artificial Sequence: Synthetic oligonucleotide
gacgacuucgagauucuga

SEQ ID NO: 9225 - RNA, 19 nt, Artificial Sequence
  Description of Artificial Sequence: Synthetic oligonucleotide
acgacuucgagauucugaa

SEQ ID NO: 9226 - RNA, 19 nt, Artificial Sequence
  Description of Artificial Sequence: Synthetic oligonucleotide
cgacuucgagauucugaaa

SEQ ID NO: 9227 - RNA, 19 nt, Artificial Sequence
  Description of Artificial Sequence: Synthetic oligonucleotide
gacuucgagauucugaaga

SEQ ID NO: 9228 - RNA, 19 nt, Artificial Sequence
  Description of Artificial Sequence: Synthetic oligonucleotide
acuucgagauucugaagga

SEQ ID NO: 9229 - RNA, 19 nt, Artificial Sequence
  Description of Artificial Sequence: Synthetic oligonucleotide
cuucgagauucugaaggua

SEQ ID NO: 9230 - RNA, 19 nt, Artificial Sequence
  Description of Artificial Sequence: Synthetic oligonucleotide
uucgagauucugaagguga

SEQ ID NO: 9231 - RNA, 19 nt, Artificial Sequence
  Description of Artificial Sequence: Synthetic oligonucleotide
ucgagauucugaaggugaa

SEQ ID NO: 9232 - RNA, 19 nt, Artificial Sequence
  Description of Artificial Sequence: Synthetic oligonucleotide
cgagauucugaaggugaua

SEQ ID NO: 9233 - RNA, 19 nt, Artificial Sequence
  Description of Artificial Sequence: Synthetic oligonucleotide
gagauucugaaggugauca

SEQ ID NO: 9234 - RNA, 19 nt, Artificial Sequence
  Description of Artificial Sequence: Synthetic oligonucleotide
agauucugaaggugaucga

SEQ ID NO: 9235 - RNA, 19 nt, Artificial Sequence
  Description of Artificial Sequence: Synthetic oligonucleotide
gauucugaaggugaucgga

SEQ ID NO: 9236 - RNA, 19 nt, Artificial Sequence
  Description of Artificial Sequence: Synthetic oligonucleotide
auucugaaggugaucggaa

SEQ ID NO: 9237 - RNA, 19 nt, Artificial Sequence
  Description of Artificial Sequence: Synthetic oligonucleotide
uucugaaggugaucggaca

SEQ ID NO: 9238 - RNA, 19 nt, Artificial Sequence
  Description of Artificial Sequence: Synthetic oligonucleotide
ucugaaggugaucggacga

SEQ ID NO: 9239 - RNA, 19 nt, Artificial Sequence
  Description of Artificial Sequence: Synthetic oligonucleotide
cugaaggugaucggacgca

SEQ ID NO: 9240 - RNA, 19 nt, Artificial Sequence
  Description of Artificial Sequence: Synthetic oligonucleotide
ugaaggugaucggacgcga

SEQ ID NO: 9241 - RNA, 19 nt, Artificial Sequence
  Description of Artificial Sequence: Synthetic oligonucleotide
gaaggugaucggacgcgga

SEQ ID NO: 9242 - RNA, 19 nt, Artificial Sequence
  Description of Artificial Sequence: Synthetic oligonucleotide
aaggugaucggacgcggga

SEQ ID NO: 9243 - RNA, 19 nt, Artificial Sequence
  Description of Artificial Sequence: Synthetic oligonucleotide
aggugaucggacgcgggga

SEQ ID NO: 9244 - RNA, 19 nt, Artificial Sequence
  Description of Artificial Sequence: Synthetic oligonucleotide
ggugaucggacgcggggca

SEQ ID NO: 9245 - RNA, 19 nt, Artificial Sequence
  Description of Artificial Sequence: Synthetic oligonucleotide
gugaucggacgcggggcga

SEQ ID NO: 9246 - RNA, 19 nt, Artificial Sequence
  Description of Artificial Sequence: Synthetic oligonucleotide
ugaucggacgcggggcgua

SEQ ID NO: 9247 - RNA, 19 nt, Artificial Sequence
  Description of Artificial Sequence: Synthetic oligonucleotide
gaucggacgcggggcguua

SEQ ID NO: 9248 - RNA, 19 nt, Artificial Sequence
  Description of Artificial Sequence: Synthetic oligonucleotide
aucggacgcggggcguuca

SEQ ID NO: 9249 - RNA, 19 nt, Artificial Sequence
  Description of Artificial Sequence: Synthetic oligonucleotide
ucggacgcggggcguucaa

SEQ ID NO: 9250 - RNA, 19 nt, Artificial Sequence
  Description of Artificial Sequence: Synthetic oligonucleotide
cggacgcggggcguucaga

SEQ ID NO: 9251 - RNA, 19 nt, Artificial Sequence
  Description of Artificial Sequence: Synthetic oligonucleotide
ggacgcggggcguucagca

SEQ ID NO: 9252 - RNA, 19 nt, Artificial Sequence
  Description of Artificial Sequence: Synthetic oligonucleotide
gacgcggggcguucagcga

SEQ ID NO: 9253 - RNA, 19 nt, Artificial Sequence
  Description of Artificial Sequence: Synthetic oligonucleotide
acgcggggcguucagcgaa

SEQ ID NO: 9254 - RNA, 19 nt, Artificial Sequence
  Description of Artificial Sequence: Synthetic oligonucleotide
cgcggggcguucagcgaga

SEQ ID NO: 9255 - RNA, 19 nt, Artificial Sequence
  Description of Artificial Sequence: Synthetic oligonucleotide
gcggggcguucagcgagga

SEQ ID NO: 9256 - RNA, 19 nt, Artificial Sequence
  Description of Artificial Sequence: Synthetic oligonucleotide
cggggcguucagcgaggua

SEQ ID NO: 9257 - RNA, 19 nt, Artificial Sequence
  Description of Artificial Sequence: Synthetic oligonucleotide
ggggcguucagcgagguaa

SEQ ID NO: 9258 - RNA, 19 nt, Artificial Sequence
  Description of Artificial Sequence: Synthetic oligonucleotide
gggcguucagcgagguaga

SEQ ID NO: 9259 - RNA, 19 nt, Artificial Sequence
  Description of Artificial Sequence: Synthetic oligonucleotide
ggcguucagcgagguagca

SEQ ID NO: 9260 - RNA, 19 nt, Artificial Sequence
  Description of Artificial Sequence: Synthetic oligonucleotide
gcguucagcgagguagcga

SEQ ID NO: 9261 - RNA, 19 nt, Artificial Sequence
  Description of Artificial Sequence: Synthetic oligonucleotide
cguucagcgagguagcgga

SEQ ID NO: 9262 - RNA, 19 nt, Artificial Sequence
  Description of Artificial Sequence: Synthetic oligonucleotide
guucagcgagguagcggua

SEQ ID NO: 9263 - RNA, 19 nt, Artificial Sequence
  Description of Artificial Sequence: Synthetic oligonucleotide
uucagcgagguagcgguaa

SEQ ID NO: 9264 - RNA, 19 nt, Artificial Sequence
  Description of Artificial Sequence: Synthetic oligonucleotide
ucagcgagguagcgguaga

SEQ ID NO: 9265 - RNA, 19 nt, Artificial Sequence
  Description of Artificial Sequence: Synthetic oligonucleotide
cagcgagguagcgguagua

SEQ ID NO: 9266 - RNA, 19 nt, Artificial Sequence
  Description of Artificial Sequence: Synthetic oligonucleotide
agcgagguagcgguaguga

SEQ ID NO: 9267 - RNA, 19 nt, Artificial Sequence
  Description of Artificial Sequence: Synthetic oligonucleotide
gcgagguagcgguagugaa

SEQ ID NO: 9268 - RNA, 19 nt, Artificial Sequence
  Description of Artificial Sequence: Synthetic oligonucleotide
cgagguagcgguagugaaa

SEQ ID NO: 9269 - RNA, 19 nt, Artificial Sequence
  Description of Artificial Sequence: Synthetic oligonucleotide
gagguagcgguagugaaga

SEQ ID NO: 9270 - RNA, 19 nt, Artificial Sequence
  Description of Artificial Sequence: Synthetic oligonucleotide
agguagcgguagugaagaa

SEQ ID NO: 9271 - RNA, 19 nt, Artificial Sequence
  Description of Artificial Sequence: Synthetic oligonucleotide
gguagcgguagugaagaua

SEQ ID NO: 9272 - RNA, 19 nt, Artificial Sequence
  Description of Artificial Sequence: Synthetic oligonucleotide
guagcgguagugaagauga

SEQ ID NO: 9273 - RNA, 19 nt, Artificial Sequence
  Description of Artificial Sequence: Synthetic oligonucleotide
uagcgguagugaagaugaa

SEQ ID NO: 9274 - RNA, 19 nt, Artificial Sequence
  Description of Artificial Sequence: Synthetic oligonucleotide
agcgguagugaagaugaaa

SEQ ID NO: 9275 - RNA, 19 nt, Artificial Sequence
  Description of Artificial Sequence: Synthetic oligonucleotide
gcgguagugaagaugaaga

SEQ ID NO: 9276 - RNA, 19 nt, Artificial Sequence
  Description of Artificial Sequence: Synthetic oligonucleotide
cgguagugaagaugaagca

SEQ ID NO: 9277 - RNA, 19 nt, Artificial Sequence
  Description of Artificial Sequence: Synthetic oligonucleotide
gguagugaagaugaagcaa

SEQ ID NO: 9278 - RNA, 19 nt, Artificial Sequence
  Description of Artificial Sequence: Synthetic oligonucleotide
guagugaagaugaagcaga

SEQ ID NO: 9279 - RNA, 19 nt, Artificial Sequence
  Description of Artificial Sequence: Synthetic oligonucleotide
uagugaagaugaagcagaa

SEQ ID NO: 9280 - RNA, 19 nt, Artificial Sequence
  Description of Artificial Sequence: Synthetic oligonucleotide
agugaagaugaagcagaca

SEQ ID NO: 9281 - RNA, 19 nt, Artificial Sequence
  Description of Artificial Sequence: Synthetic oligonucleotide
gugaagaugaagcagacga

SEQ ID NO: 9282 - RNA, 19 nt, Artificial Sequence
  Description of Artificial Sequence: Synthetic oligonucleotide
ugaagaugaagcagacgga

SEQ ID NO: 9283 - RNA, 19 nt, Artificial Sequence
  Description of Artificial Sequence: Synthetic oligonucleotide
gaagaugaagcagacggga

SEQ ID NO: 9284 - RNA, 19 nt, Artificial Sequence
  Description of Artificial Sequence: Synthetic oligonucleotide
aagaugaagcagacgggca

SEQ ID NO: 9285 - RNA, 19 nt, Artificial Sequence
  Description of Artificial Sequence: Synthetic oligonucleotide
agaugaagcagacgggcca

SEQ ID NO: 9286 - RNA, 19 nt, Artificial Sequence
  Description of Artificial Sequence: Synthetic oligonucleotide
gaugaagcagacgggccaa

SEQ ID NO: 9287 - RNA, 19 nt, Artificial Sequence
  Description of Artificial Sequence: Synthetic oligonucleotide
augaagcagacgggccaga

SEQ ID NO: 9288 - RNA, 19 nt, Artificial Sequence
  Description of Artificial Sequence: Synthetic oligonucleotide
ugaagcagacgggccagga

SEQ ID NO: 9289 - RNA, 19 nt, Artificial Sequence
  Description of Artificial Sequence: Synthetic oligonucleotide
gaagcagacgggccaggua

SEQ ID NO: 9290 - RNA, 19 nt, Artificial Sequence
  Description of Artificial Sequence: Synthetic oligonucleotide
aagcagacgggccagguga

SEQ ID NO: 9291 - RNA, 19 nt, Artificial Sequence
  Description of Artificial Sequence: Synthetic oligonucleotide
agcagacgggccaggugua

SEQ ID NO: 9292 - RNA, 19 nt, Artificial Sequence
  Description of Artificial Sequence: Synthetic oligonucleotide
gcagacgggccagguguaa

SEQ ID NO: 9293 - RNA, 19 nt, Artificial Sequence
  Description of Artificial Sequence: Synthetic oligonucleotide
cagacgggccagguguaua

SEQ ID NO: 9294 - RNA, 19 nt, Artificial Sequence
  Description of Artificial Sequence: Synthetic oligonucleotide
agacgggccagguguauga

SEQ ID NO: 9295 - RNA, 19 nt, Artificial Sequence
  Description of Artificial Sequence: Synthetic oligonucleotide
gacgggccagguguaugca

SEQ ID NO: 9296 - RNA, 19 nt, Artificial Sequence
  Description of Artificial Sequence: Synthetic oligonucleotide
acgggccagguguaugcca

SEQ ID NO: 9297 - RNA, 19 nt, Artificial Sequence
  Description of Artificial Sequence: Synthetic oligonucleotide
cgggccagguguaugccaa

SEQ ID NO: 9298 - RNA, 19 nt, Artificial Sequence
  Description of Artificial Sequence: Synthetic oligonucleotide
gggccagguguaugccaua

SEQ ID NO: 9299 - RNA, 19 nt, Artificial Sequence
  Description of Artificial Sequence: Synthetic oligonucleotide
ggccagguguaugccauga

SEQ ID NO: 9300 - RNA, 19 nt, Artificial Sequence
  Description of Artificial Sequence: Synthetic oligonucleotide
gccagguguaugccaugaa

SEQ ID NO: 9301 - RNA, 19 nt, Artificial Sequence
  Description of Artificial Sequence: Synthetic oligonucleotide
ccagguguaugccaugaaa

SEQ ID NO: 9302 - RNA, 19 nt, Artificial Sequence
  Description of Artificial Sequence: Synthetic oligonucleotide
cagguguaugccaugaaga

SEQ ID NO: 9303 - RNA, 19 nt, Artificial Sequence
  Description of Artificial Sequence: Synthetic oligonucleotide
agguguaugccaugaagaa

SEQ ID NO: 9304 - RNA, 19 nt, Artificial Sequence
  Description of Artificial Sequence: Synthetic oligonucleotide
gguguaugccaugaagaua

SEQ ID NO: 9305 - RNA, 19 nt, Artificial Sequence
  Description of Artificial Sequence: Synthetic oligonucleotide
guguaugccaugaagauca

SEQ ID NO: 9306 - RNA, 19 nt, Artificial Sequence
  Description of Artificial Sequence: Synthetic oligonucleotide
uguaugccaugaagaucaa

SEQ ID NO: 9307 - RNA, 19 nt, Artificial Sequence
  Description of Artificial Sequence: Synthetic oligonucleotide
guaugccaugaagaucaua

SEQ ID NO: 9308 - RNA, 19 nt, Artificial Sequence
  Description of Artificial Sequence: Synthetic oligonucleotide
uaugccaugaagaucauga

SEQ ID NO: 9309 - RNA, 19 nt, Artificial Sequence
  Description of Artificial Sequence: Synthetic oligonucleotide
augccaugaagaucaugaa

SEQ ID NO: 9310 - RNA, 19 nt, Artificial Sequence
  Description of Artificial Sequence: Synthetic oligonucleotide
ugccaugaagaucaugaaa

SEQ ID NO: 9311 - RNA, 19 nt, Artificial Sequence
  Description of Artificial Sequence: Synthetic oligonucleotide
gccaugaagaucaugaaca

SEQ ID NO: 9312 - RNA, 19 nt, Artificial Sequence
  Description of Artificial Sequence: Synthetic oligonucleotide
ccaugaagaucaugaacaa

SEQ ID NO: 9313 - RNA, 19 nt, Artificial Sequence
  Description of Artificial Sequence: Synthetic oligonucleotide
caugaagaucaugaacaaa

SEQ ID NO: 9314 - RNA, 19 nt, Artificial Sequence
  Description of Artificial Sequence: Synthetic oligonucleotide
augaagaucaugaacaaga

SEQ ID NO: 9315 - RNA, 19 nt, Artificial Sequence
  Description of Artificial Sequence: Synthetic oligonucleotide
ugaagaucaugaacaagua

SEQ ID NO: 9316 - RNA, 19 nt, Artificial Sequence
  Description of Artificial Sequence: Synthetic oligonucleotide
gaagaucaugaacaaguga

SEQ ID NO: 9317 - RNA, 19 nt, Artificial Sequence
  Description of Artificial Sequence: Synthetic oligonucleotide
aagaucaugaacaagugga

SEQ ID NO: 9318 - RNA, 19 nt, Artificial Sequence
  Description of Artificial Sequence: Synthetic oligonucleotide
agaucaugaacaaguggga

SEQ ID NO: 9319 - RNA, 19 nt, Artificial Sequence
  Description of Artificial Sequence: Synthetic oligonucleotide
gaucaugaacaagugggaa

SEQ ID NO: 9320 - RNA, 19 nt, Artificial Sequence
  Description of Artificial Sequence: Synthetic oligonucleotide
aucaugaacaagugggaca

SEQ ID NO: 9321 - RNA, 19 nt, Artificial Sequence
  Description of Artificial Sequence: Synthetic oligonucleotide
ucaugaacaagugggacaa

SEQ ID NO: 9322 - RNA, 19 nt, Artificial Sequence
  Description of Artificial Sequence: Synthetic oligonucleotide
caugaacaagugggacaua

SEQ ID NO: 9323 - RNA, 19 nt, Artificial Sequence
  Description of Artificial Sequence: Synthetic oligonucleotide
augaacaagugggacauga

SEQ ID NO: 9324 - RNA, 19 nt, Artificial Sequence
  Description of Artificial Sequence: Synthetic oligonucleotide
ugaacaagugggacaugca

SEQ ID NO: 9325 - RNA, 19 nt, Artificial Sequence
  Description of Artificial Sequence: Synthetic oligonucleotide
gaacaagugggacaugcua

SEQ ID NO: 9326 - RNA, 19 nt, Artificial Sequence
  Description of Artificial Sequence: Synthetic oligonucleotide
aacaagugggacaugcuga

SEQ ID NO: 9327 - RNA, 19 nt, Artificial Sequence
  Description of Artificial Sequence: Synthetic oligonucleotide
acaagugggacaugcugaa

SEQ ID NO: 9328 - RNA, 19 nt, Artificial Sequence
  Description of Artificial Sequence: Synthetic oligonucleotide
caagugggacaugcugaaa

SEQ ID NO: 9329 - RNA, 19 nt, Artificial Sequence
  Description of Artificial Sequence: Synthetic oligonucleotide
aagugggacaugcugaaga

SEQ ID NO: 9330 - RNA, 19 nt, Artificial Sequence
  Description of Artificial Sequence: Synthetic oligonucleotide
agugggacaugcugaagaa

SEQ ID NO: 9331 - RNA, 19 nt, Artificial Sequence
  Description of Artificial Sequence: Synthetic oligonucleotide
gugggacaugcugaagaga

SEQ ID NO: 9332 - RNA, 19 nt, Artificial Sequence
  Description of Artificial Sequence: Synthetic oligonucleotide
ugggacaugcugaagagga

SEQ ID NO: 9333 - RNA, 19 nt, Artificial Sequence
  Description of Artificial Sequence: Synthetic oligonucleotide
gggacaugcugaagaggga

SEQ ID NO: 9334 - RNA, 19 nt, Artificial Sequence
  Description of Artificial Sequence: Synthetic oligonucleotide
ggacaugcugaagagggga

SEQ ID NO: 9335 - RNA, 19 nt, Artificial Sequence
  Description of Artificial Sequence: Synthetic oligonucleotide
gacaugcugaagaggggca

SEQ ID NO: 9336 - RNA, 19 nt, Artificial Sequence
  Description of Artificial Sequence: Synthetic oligonucleotide
acaugcugaagaggggcga

SEQ ID NO: 9337 - RNA, 19 nt, Artificial Sequence
  Description of Artificial Sequence: Synthetic oligonucleotide
caugcugaagaggggcgaa

SEQ ID NO: 9338 - RNA, 19 nt, Artificial Sequence
  Description of Artificial Sequence: Synthetic oligonucleotide
augcugaagaggggcgaga

SEQ ID NO: 9339 - RNA, 19 nt, Artificial Sequence
  Description of Artificial Sequence: Synthetic oligonucleotide
ugcugaagaggggcgagga

SEQ ID NO: 9340 - RNA, 19 nt, Artificial Sequence
  Description of Artificial Sequence: Synthetic oligonucleotide
gcugaagaggggcgaggua

SEQ ID NO: 9341 - RNA, 19 nt, Artificial Sequence
  Description of Artificial Sequence: Synthetic oligonucleotide
cugaagaggggcgagguga

SEQ ID NO: 9342 - RNA, 19 nt, Artificial Sequence
  Description of Artificial Sequence: Synthetic oligonucleotide
ugaagaggggcgaggugua

SEQ ID NO: 9343 - RNA, 19 nt, Artificial Sequence
  Description of Artificial Sequence: Synthetic oligonucleotide
gaagaggggcgagguguca

SEQ ID NO: 9344 - RNA, 19 nt, Artificial Sequence
  Description of Artificial Sequence: Synthetic oligonucleotide
aagaggggcgaggugucga

SEQ ID NO: 9345 - RNA, 19 nt, Artificial Sequence
  Description of Artificial Sequence: Synthetic oligonucleotide
agaggggcgaggugucgua

SEQ ID NO: 9346 - RNA, 19 nt, Artificial Sequence
  Description of Artificial Sequence: Synthetic oligonucleotide
gaggggcgaggugucguga

SEQ ID NO: 9347 - RNA, 19 nt, Artificial Sequence
  Description of Artificial Sequence: Synthetic oligonucleotide
aggggcgaggugucgugca

SEQ ID NO: 9348 - RNA, 19 nt, Artificial Sequence
  Description of Artificial Sequence: Synthetic oligonucleotide
ggggcgaggugucgugcua

SEQ ID NO: 9349 - RNA, 19 nt, Artificial Sequence
  Description of Artificial Sequence: Synthetic oligonucleotide
gggcgaggugucgugcuua

SEQ ID NO: 9350 - RNA, 19 nt, Artificial Sequence
  Description of Artificial Sequence: Synthetic oligonucleotide
ggcgaggugucgugcuuca

SEQ ID NO: 9351 - RNA, 19 nt, Artificial Sequence
  Description of Artificial Sequence: Synthetic oligonucleotide
gcgaggugucgugcuucca

SEQ ID NO: 9352 - RNA, 19 nt, Artificial Sequence
  Description of Artificial Sequence: Synthetic oligonucleotide
cgaggugucgugcuuccga

SEQ ID NO: 9353 - RNA, 19 nt, Artificial Sequence
  Description of Artificial Sequence: Synthetic oligonucleotide
gaggugucgugcuuccgua

SEQ ID NO: 9354 - RNA, 19 nt, Artificial Sequence
  Description of Artificial Sequence: Synthetic oligonucleotide
aggugucgugcuuccguga

SEQ ID NO: 9355 - RNA, 19 nt, Artificial Sequence
  Description of Artificial Sequence: Synthetic oligonucleotide
ggugucgugcuuccgugaa

SEQ ID NO: 9356 - RNA, 19 nt, Artificial Sequence
  Description of Artificial Sequence: Synthetic oligonucleotide
gugucgugcuuccgugaga

SEQ ID NO: 9357 - RNA, 19 nt, Artificial Sequence
  Description of Artificial Sequence: Synthetic oligonucleotide
ugucgugcuuccgugagga

SEQ ID NO: 9358 - RNA, 19 nt, Artificial Sequence
  Description of Artificial Sequence: Synthetic oligonucleotide
gucgugcuuccgugaggaa

SEQ ID NO: 9359 - RNA, 19 nt, Artificial Sequence
  Description of Artificial Sequence: Synthetic oligonucleotide
ucgugcuuccgugaggaga

SEQ ID NO: 9360 - RNA, 19 nt, Artificial Sequence
  Description of Artificial Sequence: Synthetic oligonucleotide
cgugcuuccgugaggagaa

SEQ ID NO: 9361 - RNA, 19 nt, Artificial Sequence
  Description of Artificial Sequence: Synthetic oligonucleotide
gugcuuccgugaggagaga

SEQ ID NO: 9362 - RNA, 19 nt, Artificial Sequence
  Description of Artificial Sequence: Synthetic oligonucleotide
ugcuuccgugaggagagga

SEQ ID NO: 9363 - RNA, 19 nt, Artificial Sequence
  Description of Artificial Sequence: Synthetic oligonucleotide
gcuuccgugaggagaggga

SEQ ID NO: 9364 - RNA, 19 nt, Artificial Sequence
  Description of Artificial Sequence: Synthetic oligonucleotide
cuuccgugaggagagggaa

SEQ ID NO: 9365 - RNA, 19 nt, Artificial Sequence
  Description of Artificial Sequence: Synthetic oligonucleotide
uuccgugaggagagggaca

SEQ ID NO: 9366 - RNA, 19 nt, Artificial Sequence
  Description of Artificial Sequence: Synthetic oligonucleotide
uccgugaggagagggacga

SEQ ID NO: 9367 - RNA, 19 nt, Artificial Sequence
  Description of Artificial Sequence: Synthetic oligonucleotide
ccgugaggagagggacgua

SEQ ID NO: 9368 - RNA, 19 nt, Artificial Sequence
  Description of Artificial Sequence: Synthetic oligonucleotide
cgugaggagagggacguga

SEQ ID NO: 9369 - RNA, 19 nt, Artificial Sequence
  Description of Artificial Sequence: Synthetic oligonucleotide
gugaggagagggacgugua

SEQ ID NO: 9370 - RNA, 19 nt, Artificial Sequence
  Description of Artificial Sequence: Synthetic oligonucleotide
ugaggagagggacguguua

SEQ ID NO: 9371 - RNA, 19 nt, Artificial Sequence
  Description of Artificial Sequence: Synthetic oligonucleotide
gaggagagggacguguuga

SEQ ID NO: 9372 - RNA, 19 nt, Artificial Sequence
  Description of Artificial Sequence: Synthetic oligonucleotide
aggagagggacguguugga

SEQ ID NO: 9373 - RNA, 19 nt, Artificial Sequence
  Description of Artificial Sequence: Synthetic oligonucleotide
ggagagggacguguuggua

SEQ ID NO: 9374 - RNA, 19 nt, Artificial Sequence
  Description of Artificial Sequence: Synthetic oligonucleotide
gagagggacguguugguga

SEQ ID NO: 9375 - RNA, 19 nt, Artificial Sequence
  Description of Artificial Sequence: Synthetic oligonucleotide
agagggacguguuggugaa

SEQ ID NO: 9376 - RNA, 19 nt, Artificial Sequence
  Description of Artificial Sequence: Synthetic oligonucleotide
gagggacguguuggugaaa

SEQ ID NO: 9377 - RNA, 19 nt, Artificial Sequence
  Description of Artificial Sequence: Synthetic oligonucleotide
agggacguguuggugaaua

SEQ ID NO: 9378 - RNA, 19 nt, Artificial Sequence
  Description of Artificial Sequence: Synthetic oligonucleotide
gggacguguuggugaauga

SEQ ID NO: 9379 - RNA, 19 nt, Artificial Sequence
  Description of Artificial Sequence: Synthetic oligonucleotide
ggacguguuggugaaugga

SEQ ID NO: 9380 - RNA, 19 nt, Artificial Sequence
  Description of Artificial Sequence: Synthetic oligonucleotide
gacguguuggugaauggga

SEQ ID NO: 9381 - RNA, 19 nt, Artificial Sequence
  Description of Artificial Sequence: Synthetic oligonucleotide
acguguuggugaaugggga

SEQ ID NO: 9382 - RNA, 19 nt, Artificial Sequence
  Description of Artificial Sequence: Synthetic oligonucleotide
cguguuggugaauggggaa

SEQ ID NO: 9383 - RNA, 19 nt, Artificial Sequence
  Description of Artificial Sequence: Synthetic oligonucleotide
guguuggugaauggggaca

SEQ ID NO: 9384 - RNA, 19 nt, Artificial Sequence
  Description of Artificial Sequence: Synthetic oligonucleotide
uguuggugaauggggacca

SEQ ID NO: 9385 - RNA, 19 nt, Artificial Sequence
  Description of Artificial Sequence: Synthetic oligonucleotide
guuggugaauggggaccga

SEQ ID NO: 9386 - RNA, 19 nt, Artificial Sequence
  Description of Artificial Sequence: Synthetic oligonucleotide
uuggugaauggggaccgga

SEQ ID NO: 9387 - RNA, 19 nt, Artificial Sequence
  Description of Artificial Sequence: Synthetic oligonucleotide
uggugaauggggaccggca

SEQ ID NO: 9388 - RNA, 19 nt, Artificial Sequence
  Description of Artificial Sequence: Synthetic oligonucleotide
ggugaauggggaccggcga

SEQ ID NO: 9389 - RNA, 19 nt, Artificial Sequence
  Description of Artificial Sequence: Synthetic oligonucleotide
gugaauggggaccggcgga

SEQ ID NO: 9390 - RNA, 19 nt, Artificial Sequence
  Description of Artificial Sequence: Synthetic oligonucleotide
ugaauggggaccggcggua

SEQ ID NO: 9391 - RNA, 19 nt, Artificial Sequence
  Description of Artificial Sequence: Synthetic oligonucleotide
gaauggggaccggcgguga

SEQ ID NO: 9392 - RNA, 19 nt, Artificial Sequence
  Description of Artificial Sequence: Synthetic oligonucleotide
aauggggaccggcggugga

SEQ ID NO: 9393 - RNA, 19 nt, Artificial Sequence
  Description of Artificial Sequence: Synthetic oligonucleotide
auggggaccggcgguggaa

SEQ ID NO: 9394 - RNA, 19 nt, Artificial Sequence
  Description of Artificial Sequence: Synthetic oligonucleotide
uggggaccggcgguggaua

SEQ ID NO: 9395 - RNA, 19 nt, Artificial Sequence
  Description of Artificial Sequence: Synthetic oligonucleotide
ggggaccggcgguggauca

SEQ ID NO: 9396 - RNA, 19 nt, Artificial Sequence
  Description of Artificial Sequence: Synthetic oligonucleotide
gggaccggcgguggaucaa

SEQ ID NO: 9397 - RNA, 19 nt, Artificial Sequence
  Description of Artificial Sequence: Synthetic oligonucleotide
ggaccggcgguggaucaca

SEQ ID NO: 9398 - RNA, 19 nt, Artificial Sequence
  Description of Artificial Sequence: Synthetic oligonucleotide
gaccggcgguggaucacga

SEQ ID NO: 9399 - RNA, 19 nt, Artificial Sequence
  Description of Artificial Sequence: Synthetic oligonucleotide
accggcgguggaucacgca

SEQ ID NO: 9400 - RNA, 19 nt, Artificial Sequence
  Description of Artificial Sequence: Synthetic oligonucleotide
ccggcgguggaucacgcaa

SEQ ID NO: 9401 - RNA, 19 nt, Artificial Sequence
  Description of Artificial Sequence: Synthetic oligonucleotide
cggcgguggaucacgcaga

SEQ ID NO: 9402 - RNA, 19 nt, Artificial Sequence
  Description of Artificial Sequence: Synthetic oligonucleotide
ggcgguggaucacgcagca

SEQ ID NO: 9403 - RNA, 19 nt, Artificial Sequence
  Description of Artificial Sequence: Synthetic oligonucleotide
gcgguggaucacgcagcua

SEQ ID NO: 9404 - RNA, 19 nt, Artificial Sequence
  Description of Artificial Sequence: Synthetic oligonucleotide
cgguggaucacgcagcuga

SEQ ID NO: 9405 - RNA, 19 nt, Artificial Sequence
  Description of Artificial Sequence: Synthetic oligonucleotide
gguggaucacgcagcugca

SEQ ID NO: 9406 - RNA, 19 nt, Artificial Sequence
  Description of Artificial Sequence: Synthetic oligonucleotide
guggaucacgcagcugcaa

SEQ ID NO: 9407 - RNA, 19 nt, Artificial Sequence
  Description of Artificial Sequence: Synthetic oligonucleotide
uggaucacgcagcugcaca

SEQ ID NO: 9408 - RNA, 19 nt, Artificial Sequence
  Description of Artificial Sequence: Synthetic oligonucleotide
ggaucacgcagcugcacua

SEQ ID NO: 9409 - RNA, 19 nt, Artificial Sequence
  Description of Artificial Sequence: Synthetic oligonucleotide
gaucacgcagcugcacuua

SEQ ID NO: 9410 - RNA, 19 nt, Artificial Sequence
  Description of Artificial Sequence: Synthetic oligonucleotide
aucacgcagcugcacuuca

SEQ ID NO: 9411 - RNA, 19 nt, Artificial Sequence
  Description of Artificial Sequence: Synthetic oligonucleotide
ucacgcagcugcacuucga

SEQ ID NO: 9412 - RNA, 19 nt, Artificial Sequence
  Description of Artificial Sequence: Synthetic oligonucleotide
cacgcagcugcacuucgca

SEQ ID NO: 9413 - RNA, 19 nt, Artificial Sequence
  Description of Artificial Sequence: Synthetic oligonucleotide
acgcagcugcacuucgcca

SEQ ID NO: 9414 - RNA, 19 nt, Artificial Sequence
  Description of Artificial Sequence: Synthetic oligonucleotide
cgcagcugcacuucgccua

SEQ ID NO: 9415 - RNA, 19 nt, Artificial Sequence
  Description of Artificial Sequence: Synthetic oligonucleotide
gcagcugcacuucgccuua

SEQ ID NO: 9416 - RNA, 19 nt, Artificial Sequence
  Description of Artificial Sequence: Synthetic oligonucleotide
cagcugcacuucgccuuca

SEQ ID NO: 9417 - RNA, 19 nt, Artificial Sequence
  Description of Artificial Sequence: Synthetic oligonucleotide
agcugcacuucgccuucca

SEQ ID NO: 9418 - RNA, 19 nt, Artificial Sequence
  Description of Artificial Sequence: Synthetic oligonucleotide
gcugcacuucgccuuccaa

SEQ ID NO: 9419 - RNA, 19 nt, Artificial Sequence
  Description of Artificial Sequence: Synthetic oligonucleotide
cugcacuucgccuuccaga

SEQ ID NO: 9420 - RNA, 19 nt, Artificial Sequence
  Description of Artificial Sequence: Synthetic oligonucleotide
ugcacuucgccuuccagga

SEQ ID NO: 9421 - RNA, 19 nt, Artificial Sequence
  Description of Artificial Sequence: Synthetic oligonucleotide
gcacuucgccuuccaggaa

SEQ ID NO: 9422 - RNA, 19 nt, Artificial Sequence
  Description of Artificial Sequence: Synthetic oligonucleotide
cacuucgccuuccaggaua

SEQ ID NO: 9423 - RNA, 19 nt, Artificial Sequence
  Description of Artificial Sequence: Synthetic oligonucleotide
acuucgccuuccaggauga

SEQ ID NO: 9424 - RNA, 19 nt, Artificial Sequence
  Description of Artificial Sequence: Synthetic oligonucleotide
cuucgccuuccaggaugaa

SEQ ID NO: 9425 - RNA, 19 nt, Artificial Sequence
  Description of Artificial Sequence: Synthetic oligonucleotide
uucgccuuccaggaugaga

SEQ ID NO: 9426 - RNA, 19 nt, Artificial Sequence
  Description of Artificial Sequence: Synthetic oligonucleotide
ucgccuuccaggaugagaa

SEQ ID NO: 9427 - RNA, 19 nt, Artificial Sequence
  Description of Artificial Sequence: Synthetic oligonucleotide
cgccuuccaggaugagaaa

SEQ ID NO: 9428 - RNA, 19 nt, Artificial Sequence
  Description of Artificial Sequence: Synthetic oligonucleotide
gccuuccaggaugagaaca

SEQ ID NO: 9429 - RNA, 19 nt, Artificial Sequence
  Description of Artificial Sequence: Synthetic oligonucleotide
ccuuccaggaugagaacua

SEQ ID NO: 9430 - RNA, 19 nt, Artificial Sequence
  Description of Artificial Sequence: Synthetic oligonucleotide
cuuccaggaugagaacuaa

SEQ ID NO: 9431 - RNA, 19 nt, Artificial Sequence
  Description of Artificial Sequence: Synthetic oligonucleotide
uuccaggaugagaacuaca

SEQ ID NO: 9432 - RNA, 19 nt, Artificial Sequence
  Description of Artificial Sequence: Synthetic oligonucleotide
uccaggaugagaacuacca

SEQ ID NO: 9433 - RNA, 19 nt, Artificial Sequence
  Description of Artificial Sequence: Synthetic oligonucleotide
ccaggaugagaacuaccua

SEQ ID NO: 9434 - RNA, 19 nt, Artificial Sequence
  Description of Artificial Sequence: Synthetic oligonucleotide
caggaugagaacuaccuga

SEQ ID NO: 9435 - RNA, 19 nt, Artificial Sequence
  Description of Artificial Sequence: Synthetic oligonucleotide
aggaugagaacuaccugua

SEQ ID NO: 9436 - RNA, 19 nt, Artificial Sequence
  Description of Artificial Sequence: Synthetic oligonucleotide
ggaugagaacuaccuguaa

SEQ ID NO: 9437 - RNA, 19 nt, Artificial Sequence
  Description of Artificial Sequence: Synthetic oligonucleotide
gaugagaacuaccuguaca

SEQ ID NO: 9438 - RNA, 19 nt, Artificial Sequence
  Description of Artificial Sequence: Synthetic oligonucleotide
augagaacuaccuguacca

SEQ ID NO: 9439 - RNA, 19 nt, Artificial Sequence
  Description of Artificial Sequence: Synthetic oligonucleotide
ugagaacuaccuguaccua

SEQ ID NO: 9440 - RNA, 19 nt, Artificial Sequence
  Description of Artificial Sequence: Synthetic oligonucleotide
gagaacuaccuguaccuga

SEQ ID NO: 9441 - RNA, 19 nt, Artificial Sequence
  Description of Artificial Sequence: Synthetic oligonucleotide
agaacuaccuguaccugga

SEQ ID NO: 9442 - RNA, 19 nt, Artificial Sequence
  Description of Artificial Sequence: Synthetic oligonucleotide
gaacuaccuguaccuggua

SEQ ID NO: 9443 - RNA, 19 nt, Artificial Sequence
  Description of Artificial Sequence: Synthetic oligonucleotide
aacuaccuguaccugguca

SEQ ID NO: 9444 - RNA, 19 nt, Artificial Sequence
  Description of Artificial Sequence: Synthetic oligonucleotide
acuaccuguaccuggucaa

SEQ ID NO: 9445 - RNA, 19 nt, Artificial Sequence
  Description of Artificial Sequence: Synthetic oligonucleotide
cuaccuguaccuggucaua

SEQ ID NO: 9446 - RNA, 19 nt, Artificial Sequence
  Description of Artificial Sequence: Synthetic oligonucleotide
uaccuguaccuggucauga

SEQ ID NO: 9447 - RNA, 19 nt, Artificial Sequence
  Description of Artificial Sequence: Synthetic oligonucleotide
accuguaccuggucaugga

SEQ ID NO: 9448 - RNA, 19 nt, Artificial Sequence
  Description of Artificial Sequence: Synthetic oligonucleotide
ccuguaccuggucauggaa

SEQ ID NO: 9449 - RNA, 19 nt, Artificial Sequence
  Description of Artificial Sequence: Synthetic oligonucleotide
cuguaccuggucauggaga

SEQ ID NO: 9450 - RNA, 19 nt, Artificial Sequence
  Description of Artificial Sequence: Synthetic oligonucleotide
uguaccuggucauggagua

SEQ ID NO: 9451 - RNA, 19 nt, Artificial Sequence
  Description of Artificial Sequence: Synthetic oligonucleotide
guaccuggucauggaguaa

SEQ ID NO: 9452 - RNA, 19 nt, Artificial Sequence
  Description of Artificial Sequence: Synthetic oligonucleotide
uaccuggucauggaguaua

SEQ ID NO: 9453 - RNA, 19 nt, Artificial Sequence
  Description of Artificial Sequence: Synthetic oligonucleotide
accuggucauggaguauua

SEQ ID NO: 9454 - RNA, 19 nt, Artificial Sequence
  Description of Artificial Sequence: Synthetic oligonucleotide
ccuggucauggaguauuaa

SEQ ID NO: 9455 - RNA, 19 nt, Artificial Sequence
  Description of Artificial Sequence: Synthetic oligonucleotide
cuggucauggaguauuaca

SEQ ID NO: 9456 - RNA, 19 nt, Artificial Sequence
  Description of Artificial Sequence: Synthetic oligonucleotide
uggucauggaguauuacga

SEQ ID NO: 9457 - RNA, 19 nt, Artificial Sequence
  Description of Artificial Sequence: Synthetic oligonucleotide
ggucauggaguauuacgua

SEQ ID NO: 9458 - RNA, 19 nt, Artificial Sequence
  Description of Artificial Sequence: Synthetic oligonucleotide
gucauggaguauuacguga

SEQ ID NO: 9459 - RNA, 19 nt, Artificial Sequence
  Description of Artificial Sequence: Synthetic oligonucleotide
ucauggaguauuacgugga

SEQ ID NO: 9460 - RNA, 19 nt, Artificial Sequence
  Description of Artificial Sequence: Synthetic oligonucleotide
cauggaguauuacguggga

SEQ ID NO: 9461 - RNA, 19 nt, Artificial Sequence
  Description of Artificial Sequence: Synthetic oligonucleotide
auggaguauuacgugggca

SEQ ID NO: 9462 - RNA, 19 nt, Artificial Sequence
  Description of Artificial Sequence: Synthetic oligonucleotide
uggaguauuacgugggcga

SEQ ID NO: 9463 - RNA, 19 nt, Artificial Sequence
  Description of Artificial Sequence: Synthetic oligonucleotide
ggaguauuacgugggcgga

SEQ ID NO: 9464 - RNA, 19 nt, Artificial Sequence
  Description of Artificial Sequence: Synthetic oligonucleotide
gaguauuacgugggcggga

SEQ ID NO: 9465 - RNA, 19 nt, Artificial Sequence
  Description of Artificial Sequence: Synthetic oligonucleotide
aguauuacgugggcgggga

SEQ ID NO: 9466 - RNA, 19 nt, Artificial Sequence
  Description of Artificial Sequence: Synthetic oligonucleotide
guauuacgugggcggggaa

SEQ ID NO: 9467 - RNA, 19 nt, Artificial Sequence
  Description of Artificial Sequence: Synthetic oligonucleotide
uauuacgugggcggggaca

SEQ ID NO: 9468 - RNA, 19 nt, Artificial Sequence
  Description of Artificial Sequence: Synthetic oligonucleotide
auuacgugggcggggacca

SEQ ID NO: 9469 - RNA, 19 nt, Artificial Sequence
  Description of Artificial Sequence: Synthetic oligonucleotide
uuacgugggcggggaccua

SEQ ID NO: 9470 - RNA, 19 nt, Artificial Sequence
  Description of Artificial Sequence: Synthetic oligonucleotide
uacgugggcggggaccuga

SEQ ID NO: 9471 - RNA, 19 nt, Artificial Sequence
  Description of Artificial Sequence: Synthetic oligonucleotide
acgugggcggggaccugca

SEQ ID NO: 9472 - RNA, 19 nt, Artificial Sequence
  Description of Artificial Sequence: Synthetic oligonucleotide
cgugggcggggaccugcua

SEQ ID NO: 9473 - RNA, 19 nt, Artificial Sequence
  Description of Artificial Sequence: Synthetic oligonucleotide
gugggcggggaccugcuga

SEQ ID NO: 9474 - RNA, 19 nt, Artificial Sequence
  Description of Artificial Sequence: Synthetic oligonucleotide
ugggcggggaccugcugaa

SEQ ID NO: 9475 - RNA, 19 nt, Artificial Sequence
  Description of Artificial Sequence: Synthetic oligonucleotide
gggcggggaccugcugaca

SEQ ID NO: 9476 - RNA, 19 nt, Artificial Sequence
  Description of Artificial Sequence: Synthetic oligonucleotide
ggcggggaccugcugacaa

SEQ ID NO: 9477 - RNA, 19 nt, Artificial Sequence
  Description of Artificial Sequence: Synthetic oligonucleotide
gcggggaccugcugacaca

SEQ ID NO: 9478 - RNA, 19 nt, Artificial Sequence
  Description of Artificial Sequence: Synthetic oligonucleotide
cggggaccugcugacacua

SEQ ID NO: 9479 - RNA, 19 nt, Artificial Sequence
  Description of Artificial Sequence: Synthetic oligonucleotide
ggggaccugcugacacuga

SEQ ID NO: 9480 - RNA, 19 nt, Artificial Sequence
  Description of Artificial Sequence: Synthetic oligonucleotide
gggaccugcugacacugca

SEQ ID NO: 9481 - RNA, 19 nt, Artificial Sequence
  Description of Artificial Sequence: Synthetic oligonucleotide
ggaccugcugacacugcua

SEQ ID NO: 9482 - RNA, 19 nt, Artificial Sequence
  Description of Artificial Sequence: Synthetic oligonucleotide
gaccugcugacacugcuga

SEQ ID NO: 9483 - RNA, 19 nt, Artificial Sequence
  Description of Artificial Sequence: Synthetic oligonucleotide
accugcugacacugcugaa

SEQ ID NO: 9484 - RNA, 19 nt, Artificial Sequence
  Description of Artificial Sequence: Synthetic oligonucleotide
ccugcugacacugcugaga

SEQ ID NO: 9485 - RNA, 19 nt, Artificial Sequence
  Description of Artificial Sequence: Synthetic oligonucleotide
cugcugacacugcugagca

SEQ ID NO: 9486 - RNA, 19 nt, Artificial Sequence
  Description of Artificial Sequence: Synthetic oligonucleotide
ugcugacacugcugagcaa

SEQ ID NO: 9487 - RNA, 19 nt, Artificial Sequence
  Description of Artificial Sequence: Synthetic oligonucleotide
gcugacacugcugagcaaa

SEQ ID NO: 9488 - RNA, 19 nt, Artificial Sequence
  Description of Artificial Sequence: Synthetic oligonucleotide
cugacacugcugagcaaga

SEQ ID NO: 9489 - RNA, 19 nt, Artificial Sequence
  Description of Artificial Sequence: Synthetic oligonucleotide
ugacacugcugagcaagua

SEQ ID NO: 9490 - RNA, 19 nt, Artificial Sequence
  Description of Artificial Sequence: Synthetic oligonucleotide
gacacugcugagcaaguua

SEQ ID NO: 9491 - RNA, 19 nt, Artificial Sequence
  Description of Artificial Sequence: Synthetic oligonucleotide
acacugcugagcaaguuua

SEQ ID NO: 9492 - RNA, 19 nt, Artificial Sequence
  Description of Artificial Sequence: Synthetic oligonucleotide
cacugcugagcaaguuuga

SEQ ID NO: 9493 - RNA, 19 nt, Artificial Sequence
  Description of Artificial Sequence: Synthetic oligonucleotide
acugcugagcaaguuugga

SEQ ID NO: 9494 - RNA, 19 nt, Artificial Sequence
  Description of Artificial Sequence: Synthetic oligonucleotide
cugcugagcaaguuuggga

SEQ ID NO: 9495 - RNA, 19 nt, Artificial Sequence
  Description of Artificial Sequence: Synthetic oligonucleotide
ugcugagcaaguuugggga

SEQ ID NO: 9496 - RNA, 19 nt, Artificial Sequence
  Description of Artificial Sequence: Synthetic oligonucleotide
gcugagcaaguuuggggaa

SEQ ID NO: 9497 - RNA, 19 nt, Artificial Sequence
  Description of Artificial Sequence: Synthetic oligonucleotide
cugagcaaguuuggggaga

SEQ ID NO: 9498 - RNA, 19 nt, Artificial Sequence
  Description of Artificial Sequence: Synthetic oligonucleotide
ugagcaaguuuggggagca

SEQ ID NO: 9499 - RNA, 19 nt, Artificial Sequence
  Description of Artificial Sequence: Synthetic oligonucleotide
gagcaaguuuggggagcga

SEQ ID NO: 9500 - RNA, 19 nt, Artificial Sequence
  Description of Artificial Sequence: Synthetic oligonucleotide
agcaaguuuggggagcgga

SEQ ID NO: 9501 - RNA, 19 nt, Artificial Sequence
  Description of Artificial Sequence: Synthetic oligonucleotide
gcaaguuuggggagcggaa

SEQ ID NO: 9502 - RNA, 19 nt, Artificial Sequence
  Description of Artificial Sequence: Synthetic oligonucleotide
caaguuuggggagcggaua

SEQ ID NO: 9503 - RNA, 19 nt, Artificial Sequence
  Description of Artificial Sequence: Synthetic oligonucleotide
aaguuuggggagcggauua

SEQ ID NO: 9504 - RNA, 19 nt, Artificial Sequence
  Description of Artificial Sequence: Synthetic oligonucleotide
aguuuggggagcggauuca

SEQ ID NO: 9505 - RNA, 19 nt, Artificial Sequence
  Description of Artificial Sequence: Synthetic oligonucleotide
guuuggggagcggauucca

SEQ ID NO: 9506 - RNA, 19 nt, Artificial Sequence
  Description of Artificial Sequence: Synthetic oligonucleotide
uuuggggagcggauuccga

SEQ ID NO: 9507 - RNA, 19 nt, Artificial Sequence
  Description of Artificial Sequence: Synthetic oligonucleotide
uuggggagcggauuccgga

SEQ ID NO: 9508 - RNA, 19 nt, Artificial Sequence
  Description of Artificial Sequence: Synthetic oligonucleotide
uggggagcggauuccggca

SEQ ID NO: 9509 - RNA, 19 nt, Artificial Sequence
  Description of Artificial Sequence: Synthetic oligonucleotide
ggggagcggauuccggcca

SEQ ID NO: 9510 - RNA, 19 nt, Artificial Sequence
  Description of Artificial Sequence: Synthetic oligonucleotide
gggagcggauuccggccga

SEQ ID NO: 9511 - RNA, 19 nt, Artificial Sequence
  Description of Artificial Sequence: Synthetic oligonucleotide
ggagcggauuccggccgaa

SEQ ID NO: 9512 - RNA, 19 nt, Artificial Sequence
  Description of Artificial Sequence: Synthetic oligonucleotide
gagcggauuccggccgaga

SEQ ID NO: 9513 - RNA, 19 nt, Artificial Sequence
  Description of Artificial Sequence: Synthetic oligonucleotide
agcggauuccggccgagaa

SEQ ID NO: 9514 - RNA, 19 nt, Artificial Sequence
  Description of Artificial Sequence: Synthetic oligonucleotide
gcggauuccggccgagaua

SEQ ID NO: 9515 - RNA, 19 nt, Artificial Sequence
  Description of Artificial Sequence: Synthetic oligonucleotide
cggauuccggccgagauga

SEQ ID NO: 9516 - RNA, 19 nt, Artificial Sequence
  Description of Artificial Sequence: Synthetic oligonucleotide
ggauuccggccgagaugga

SEQ ID NO: 9517 - RNA, 19 nt, Artificial Sequence
  Description of Artificial Sequence: Synthetic oligonucleotide
gauuccggccgagauggca

SEQ ID NO: 9518 - RNA, 19 nt, Artificial Sequence
  Description of Artificial Sequence: Synthetic oligonucleotide
auuccggccgagauggcga

SEQ ID NO: 9519 - RNA, 19 nt, Artificial Sequence
  Description of Artificial Sequence: Synthetic oligonucleotide
uuccggccgagauggcgca

SEQ ID NO: 9520 - RNA, 19 nt, Artificial Sequence
  Description of Artificial Sequence: Synthetic oligonucleotide
uccggccgagauggcgcga

SEQ ID NO: 9521 - RNA, 19 nt, Artificial Sequence
  Description of Artificial Sequence: Synthetic oligonucleotide
ccggccgagauggcgcgca

SEQ ID NO: 9522 - RNA, 19 nt, Artificial Sequence
  Description of Artificial Sequence: Synthetic oligonucleotide
cggccgagauggcgcgcua

SEQ ID NO: 9523 - RNA, 19 nt, Artificial Sequence
  Description of Artificial Sequence: Synthetic oligonucleotide
ggccgagauggcgcgcuua

SEQ ID NO: 9524 - RNA, 19 nt, Artificial Sequence
  Description of Artificial Sequence: Synthetic oligonucleotide
gccgagauggcgcgcuuca

SEQ ID NO: 9525 - RNA, 19 nt, Artificial Sequence
  Description of Artificial Sequence: Synthetic oligonucleotide
ccgagauggcgcgcuucua

SEQ ID NO: 9526 - RNA, 19 nt, Artificial Sequence
  Description of Artificial Sequence: Synthetic oligonucleotide
cgagauggcgcgcuucuaa

SEQ ID NO: 9527 - RNA, 19 nt, Artificial Sequence
  Description of Artificial Sequence: Synthetic oligonucleotide
gagauggcgcgcuucuaca

SEQ ID NO: 9528 - RNA, 19 nt, Artificial Sequence
  Description of Artificial Sequence: Synthetic oligonucleotide
agauggcgcgcuucuacca

SEQ ID NO: 9529 - RNA, 19 nt, Artificial Sequence
  Description of Artificial Sequence: Synthetic oligonucleotide
gauggcgcgcuucuaccua

SEQ ID NO: 9530 - RNA, 19 nt, Artificial Sequence
  Description of Artificial Sequence: Synthetic oligonucleotide
auggcgcgcuucuaccuga

SEQ ID NO: 9531 - RNA, 19 nt, Artificial Sequence
  Description of Artificial Sequence: Synthetic oligonucleotide
uggcgcgcuucuaccugga

SEQ ID NO: 9532 - RNA, 19 nt, Artificial Sequence
  Description of Artificial Sequence: Synthetic oligonucleotide
ggcgcgcuucuaccuggca

SEQ ID NO: 9533 - RNA, 19 nt, Artificial Sequence
  Description of Artificial Sequence: Synthetic oligonucleotide
gcgcgcuucuaccuggcga

SEQ ID NO: 9534 - RNA, 19 nt, Artificial Sequence
  Description of Artificial Sequence: Synthetic oligonucleotide
cgcgcuucuaccuggcgga

SEQ ID NO: 9535 - RNA, 19 nt, Artificial Sequence
  Description of Artificial Sequence: Synthetic oligonucleotide
gcgcuucuaccuggcggaa

SEQ ID NO: 9536 - RNA, 19 nt, Artificial Sequence
  Description of Artificial Sequence: Synthetic oligonucleotide
cgcuucuaccuggcggaga

SEQ ID NO: 9537 - RNA, 19 nt, Artificial Sequence
  Description of Artificial Sequence: Synthetic oligonucleotide
gcuucuaccuggcggagaa

SEQ ID NO: 9538 - RNA, 19 nt, Artificial Sequence
  Description of Artificial Sequence: Synthetic oligonucleotide
cuucuaccuggcggagaua

SEQ ID NO: 9539 - RNA, 19 nt, Artificial Sequence
  Description of Artificial Sequence: Synthetic oligonucleotide
uucuaccuggcggagauua

SEQ ID NO: 9540 - RNA, 19 nt, Artificial Sequence
  Description of Artificial Sequence: Synthetic oligonucleotide
ucuaccuggcggagauuga

SEQ ID NO: 9541 - RNA, 19 nt, Artificial Sequence
  Description of Artificial Sequence: Synthetic oligonucleotide
cuaccuggcggagauugua

SEQ ID NO: 9542 - RNA, 19 nt, Artificial Sequence
  Description of Artificial Sequence: Synthetic oligonucleotide
uaccuggcggagauuguca

SEQ ID NO: 9543 - RNA, 19 nt, Artificial Sequence
  Description of Artificial Sequence: Synthetic oligonucleotide
accuggcggagauugucaa

SEQ ID NO: 9544 - RNA, 19 nt, Artificial Sequence
  Description of Artificial Sequence: Synthetic oligonucleotide
ccuggcggagauugucaua

SEQ ID NO: 9545 - RNA, 19 nt, Artificial Sequence
  Description of Artificial Sequence: Synthetic oligonucleotide
cuggcggagauugucauga

SEQ ID NO: 9546 - RNA, 19 nt, Artificial Sequence
  Description of Artificial Sequence: Synthetic oligonucleotide
uggcggagauugucaugga

SEQ ID NO: 9547 - RNA, 19 nt, Artificial Sequence
  Description of Artificial Sequence: Synthetic oligonucleotide
ggcggagauugucauggca

SEQ ID NO: 9548 - RNA, 19 nt, Artificial Sequence
  Description of Artificial Sequence: Synthetic oligonucleotide
gcggagauugucauggcca

SEQ ID NO: 9549 - RNA, 19 nt, Artificial Sequence
  Description of Artificial Sequence: Synthetic oligonucleotide
cggagauugucauggccaa

SEQ ID NO: 9550 - RNA, 19 nt, Artificial Sequence
  Description of Artificial Sequence: Synthetic oligonucleotide
ggagauugucauggccaua

SEQ ID NO: 9551 - RNA, 19 nt, Artificial Sequence
  Description of Artificial Sequence: Synthetic oligonucleotide
gagauugucauggccauaa

SEQ ID NO: 9552 - RNA, 19 nt, Artificial Sequence
  Description of Artificial Sequence: Synthetic oligonucleotide
agauugucauggccauaga

SEQ ID NO: 9553 - RNA, 19 nt, Artificial Sequence
  Description of Artificial Sequence: Synthetic oligonucleotide
gauugucauggccauagaa

SEQ ID NO: 9554 - RNA, 19 nt, Artificial Sequence
  Description of Artificial Sequence: Synthetic oligonucleotide
auugucauggccauagaca

SEQ ID NO: 9555 - RNA, 19 nt, Artificial Sequence
  Description of Artificial Sequence: Synthetic oligonucleotide
uugucauggccauagacua

SEQ ID NO: 9556 - RNA, 19 nt, Artificial Sequence
  Description of Artificial Sequence: Synthetic oligonucleotide
ugucauggccauagacuca

SEQ ID NO: 9557 - RNA, 19 nt, Artificial Sequence
  Description of Artificial Sequence: Synthetic oligonucleotide
gucauggccauagacucga

SEQ ID NO: 9558 - RNA, 19 nt, Artificial Sequence
  Description of Artificial Sequence: Synthetic oligonucleotide
ucauggccauagacucgga

SEQ ID NO: 9559 - RNA, 19 nt, Artificial Sequence
  Description of Artificial Sequence: Synthetic oligonucleotide
cauggccauagacucggua

SEQ ID NO: 9560 - RNA, 19 nt, Artificial Sequence
  Description of Artificial Sequence: Synthetic oligonucleotide
auggccauagacucgguga

SEQ ID NO: 9561 - RNA, 19 nt, Artificial Sequence
  Description of Artificial Sequence: Synthetic oligonucleotide
uggccauagacucggugca

SEQ ID NO: 9562 - RNA, 19 nt, Artificial Sequence
  Description of Artificial Sequence: Synthetic oligonucleotide
ggccauagacucggugcaa

SEQ ID NO: 9563 - RNA, 19 nt, Artificial Sequence
  Description of Artificial Sequence: Synthetic oligonucleotide
gccauagacucggugcaca

SEQ ID NO: 9564 - RNA, 19 nt, Artificial Sequence
  Description of Artificial Sequence: Synthetic oligonucleotide
ccauagacucggugcacca

SEQ ID NO: 9565 - RNA, 19 nt, Artificial Sequence
  Description of Artificial Sequence: Synthetic oligonucleotide
cauagacucggugcaccga

SEQ ID NO: 9566 - RNA, 19 nt, Artificial Sequence
  Description of Artificial Sequence: Synthetic oligonucleotide
auagacucggugcaccgga

SEQ ID NO: 9567 - RNA, 19 nt, Artificial Sequence
  Description of Artificial Sequence: Synthetic oligonucleotide
uagacucggugcaccggca

SEQ ID NO: 9568 - RNA, 19 nt, Artificial Sequence
  Description of Artificial Sequence: Synthetic oligonucleotide
agacucggugcaccggcua

SEQ ID NO: 9569 - RNA, 19 nt, Artificial Sequence
  Description of Artificial Sequence: Synthetic oligonucleotide
gacucggugcaccggcuua

SEQ ID NO: 9570 - RNA, 19 nt, Artificial Sequence
  Description of Artificial Sequence: Synthetic oligonucleotide
acucggugcaccggcuuga

SEQ ID NO: 9571 - RNA, 19 nt, Artificial Sequence
  Description of Artificial Sequence: Synthetic oligonucleotide
cucggugcaccggcuugga

SEQ ID NO: 9572 - RNA, 19 nt, Artificial Sequence
  Description of Artificial Sequence: Synthetic oligonucleotide
ucggugcaccggcuuggca

SEQ ID NO: 9573 - RNA, 19 nt, Artificial Sequence
  Description of Artificial Sequence: Synthetic oligonucleotide
cggugcaccggcuuggcua

SEQ ID NO: 9574 - RNA, 19 nt, Artificial Sequence
  Description of Artificial Sequence: Synthetic oligonucleotide
ggugcaccggcuuggcuaa

SEQ ID NO: 9575 - RNA, 19 nt, Artificial Sequence
  Description of Artificial Sequence: Synthetic oligonucleotide
gugcaccggcuuggcuaca

SEQ ID NO: 9576 - RNA, 19 nt, Artificial Sequence
  Description of Artificial Sequence: Synthetic oligonucleotide
ugcaccggcuuggcuacga

SEQ ID NO: 9577 - RNA, 19 nt, Artificial Sequence
  Description of Artificial Sequence: Synthetic oligonucleotide
gcaccggcuuggcuacgua

SEQ ID NO: 9578 - RNA, 19 nt, Artificial Sequence
  Description of Artificial Sequence: Synthetic oligonucleotide
caccggcuuggcuacguga

SEQ ID NO: 9579 - RNA, 19 nt, Artificial Sequence
  Description of Artificial Sequence: Synthetic oligonucleotide
accggcuuggcuacgugca

SEQ ID NO: 9580 - RNA, 19 nt, Artificial Sequence
  Description of Artificial Sequence: Synthetic oligonucleotide
ccggcuuggcuacgugcaa

SEQ ID NO: 9581 - RNA, 19 nt, Artificial Sequence
  Description of Artificial Sequence: Synthetic oligonucleotide
cggcuuggcuacgugcaca

SEQ ID NO: 9582 - RNA, 19 nt, Artificial Sequence
  Description of Artificial Sequence: Synthetic oligonucleotide
ggcuuggcuacgugcacaa

SEQ ID NO: 9583 - RNA, 19 nt, Artificial Sequence
  Description of Artificial Sequence: Synthetic oligonucleotide
gcuuggcuacgugcacaga

SEQ ID NO: 9584 - RNA, 19 nt, Artificial Sequence
  Description of Artificial Sequence: Synthetic oligonucleotide
cuuggcuacgugcacagga

SEQ ID NO: 9585 - RNA, 19 nt, Artificial Sequence
  Description of Artificial Sequence: Synthetic oligonucleotide
uuggcuacgugcacaggga

SEQ ID NO: 9586 - RNA, 19 nt, Artificial Sequence
  Description of Artificial Sequence: Synthetic oligonucleotide
uggcuacgugcacagggaa

SEQ ID NO: 9587 - RNA, 19 nt, Artificial Sequence
  Description of Artificial Sequence: Synthetic oligonucleotide
ggcuacgugcacagggaca

SEQ ID NO: 9588 - RNA, 19 nt, Artificial Sequence
  Description of Artificial Sequence: Synthetic oligonucleotide
gcuacgugcacagggacaa

SEQ ID NO: 9589 - RNA, 19 nt, Artificial Sequence
  Description of Artificial Sequence: Synthetic oligonucleotide
cuacgugcacagggacaua

SEQ ID NO: 9590 - RNA, 19 nt, Artificial Sequence
  Description of Artificial Sequence: Synthetic oligonucleotide
uacgugcacagggacauca

SEQ ID NO: 9591 - RNA, 19 nt, Artificial Sequence
  Description of Artificial Sequence: Synthetic oligonucleotide
acgugcacagggacaucaa

SEQ ID NO: 9592 - RNA, 19 nt, Artificial Sequence
  Description of Artificial Sequence: Synthetic oligonucleotide
cgugcacagggacaucaaa

SEQ ID NO: 9593 - RNA, 19 nt, Artificial Sequence
  Description of Artificial Sequence: Synthetic oligonucleotide
gugcacagggacaucaaaa

SEQ ID NO: 9594 - RNA, 19 nt, Artificial Sequence
  Description of Artificial Sequence: Synthetic oligonucleotide
ugcacagggacaucaaaca

SEQ ID NO: 9595 - RNA, 19 nt, Artificial Sequence
  Description of Artificial Sequence: Synthetic oligonucleotide
gcacagggacaucaaacca

SEQ ID NO: 9596 - RNA, 19 nt, Artificial Sequence
  Description of Artificial Sequence: Synthetic oligonucleotide
cacagggacaucaaaccca

SEQ ID NO: 9597 - RNA, 19 nt, Artificial Sequence
  Description of Artificial Sequence: Synthetic oligonucleotide
acagggacaucaaacccga

SEQ ID NO: 9598 - RNA, 19 nt, Artificial Sequence
  Description of Artificial Sequence: Synthetic oligonucleotide
cagggacaucaaacccgaa

SEQ ID NO: 9599 - RNA, 19 nt, Artificial Sequence
  Description of Artificial Sequence: Synthetic oligonucleotide
agggacaucaaacccgaca

SEQ ID NO: 9600 - RNA, 19 nt, Artificial Sequence
  Description of Artificial Sequence: Synthetic oligonucleotide
gggacaucaaacccgacaa

SEQ ID NO: 9601 - RNA, 19 nt, Artificial Sequence
  Description of Artificial Sequence: Synthetic oligonucleotide
ggacaucaaacccgacaaa

SEQ ID NO: 9602 - RNA, 19 nt, Artificial Sequence
  Description of Artificial Sequence: Synthetic oligonucleotide
gacaucaaacccgacaaca

SEQ ID NO: 9603 - RNA, 19 nt, Artificial Sequence
  Description of Artificial Sequence: Synthetic oligonucleotide
acaucaaacccgacaacaa

SEQ ID NO: 9604 - RNA, 19 nt, Artificial Sequence
  Description of Artificial Sequence: Synthetic oligonucleotide
caucaaacccgacaacaua

SEQ ID NO: 9605 - RNA, 19 nt, Artificial Sequence
  Description of Artificial Sequence: Synthetic oligonucleotide
aucaaacccgacaacauca

SEQ ID NO: 9606 - RNA, 19 nt, Artificial Sequence
  Description of Artificial Sequence: Synthetic oligonucleotide
ucaaacccgacaacaucca

SEQ ID NO: 9607 - RNA, 19 nt, Artificial Sequence
  Description of Artificial Sequence: Synthetic oligonucleotide
caaacccgacaacauccua

SEQ ID NO: 9608 - RNA, 19 nt, Artificial Sequence
  Description of Artificial Sequence: Synthetic oligonucleotide
aaacccgacaacauccuga

SEQ ID NO: 9609 - RNA, 19 nt, Artificial Sequence
  Description of Artificial Sequence: Synthetic oligonucleotide
aacccgacaacauccugca

SEQ ID NO: 9610 - RNA, 19 nt, Artificial Sequence
  Description of Artificial Sequence: Synthetic oligonucleotide
acccgacaacauccugcua

SEQ ID NO: 9611 - RNA, 19 nt, Artificial Sequence
  Description of Artificial Sequence: Synthetic oligonucleotide
cccgacaacauccugcuga

SEQ ID NO: 9612 - RNA, 19 nt, Artificial Sequence
  Description of Artificial Sequence: Synthetic oligonucleotide
ccgacaacauccugcugga

SEQ ID NO: 9613 - RNA, 19 nt, Artificial Sequence
  Description of Artificial Sequence: Synthetic oligonucleotide
cgacaacauccugcuggaa

SEQ ID NO: 9614 - RNA, 19 nt, Artificial Sequence
  Description of Artificial Sequence: Synthetic oligonucleotide
gacaacauccugcuggaca

SEQ ID NO: 9615 - RNA, 19 nt, Artificial Sequence
  Description of Artificial Sequence: Synthetic oligonucleotide
acaacauccugcuggacca

SEQ ID NO: 9616 - RNA, 19 nt, Artificial Sequence
  Description of Artificial Sequence: Synthetic oligonucleotide
caacauccugcuggaccga

SEQ ID NO: 9617 - RNA, 19 nt, Artificial Sequence
  Description of Artificial Sequence: Synthetic oligonucleotide
aacauccugcuggaccgca

SEQ ID NO: 9618 - RNA, 19 nt, Artificial Sequence
  Description of Artificial Sequence: Synthetic oligonucleotide
acauccugcuggaccgcua

SEQ ID NO: 9619 - RNA, 19 nt, Artificial Sequence
  Description of Artificial Sequence: Synthetic oligonucleotide
cauccugcuggaccgcuga

SEQ ID NO: 9620 - RNA, 19 nt, Artificial Sequence
  Description of Artificial Sequence: Synthetic oligonucleotide
auccugcuggaccgcugua

SEQ ID NO: 9621 - RNA, 19 nt, Artificial Sequence
  Description of Artificial Sequence: Synthetic oligonucleotide
uccugcuggaccgcuguga

SEQ ID NO: 9622 - RNA, 19 nt, Artificial Sequence
  Description of Artificial Sequence: Synthetic oligonucleotide
ccugcuggaccgcugugga

SEQ ID NO: 9623 - RNA, 19 nt, Artificial Sequence
  Description of Artificial Sequence: Synthetic oligonucleotide
cugcuggaccgcuguggca

SEQ ID NO: 9624 - RNA, 19 nt, Artificial Sequence
  Description of Artificial Sequence: Synthetic oligonucleotide
ugcuggaccgcuguggcca

SEQ ID NO: 9625 - RNA, 19 nt, Artificial Sequence
  Description of Artificial Sequence: Synthetic oligonucleotide
gcuggaccgcuguggccaa

SEQ ID NO: 9626 - RNA, 19 nt, Artificial Sequence
  Description of Artificial Sequence: Synthetic oligonucleotide
cuggaccgcuguggccaca

SEQ ID NO: 9627 - RNA, 19 nt, Artificial Sequence
  Description of Artificial Sequence: Synthetic oligonucleotide
uggaccgcuguggccacaa

SEQ ID NO: 9628 - RNA, 19 nt, Artificial Sequence
  Description of Artificial Sequence: Synthetic oligonucleotide
ggaccgcuguggccacaua

SEQ ID NO: 9629 - RNA, 19 nt, Artificial Sequence
  Description of Artificial Sequence: Synthetic oligonucleotide
gaccgcuguggccacauca

SEQ ID NO: 9630 - RNA, 19 nt, Artificial Sequence
  Description of Artificial Sequence: Synthetic oligonucleotide
accgcuguggccacaucca

SEQ ID NO: 9631 - RNA, 19 nt, Artificial Sequence
  Description of Artificial Sequence: Synthetic oligonucleotide
ccgcuguggccacauccga

SEQ ID NO: 9632 - RNA, 19 nt, Artificial Sequence
  Description of Artificial Sequence: Synthetic oligonucleotide
cgcuguggccacauccgca

SEQ ID NO: 9633 - RNA, 19 nt, Artificial Sequence
  Description of Artificial Sequence: Synthetic oligonucleotide
gcuguggccacauccgcca

SEQ ID NO: 9634 - RNA, 19 nt, Artificial Sequence
  Description of Artificial Sequence: Synthetic oligonucleotide
cuguggccacauccgccua

SEQ ID NO: 9635 - RNA, 19 nt, Artificial Sequence
  Description of Artificial Sequence: Synthetic oligonucleotide
uguggccacauccgccuga

SEQ ID NO: 9636 - RNA, 19 nt, Artificial Sequence
  Description of Artificial Sequence: Synthetic oligonucleotide
guggccacauccgccugga

SEQ ID NO: 9637 - RNA, 19 nt, Artificial Sequence
  Description of Artificial Sequence: Synthetic oligonucleotide
uggccacauccgccuggca

SEQ ID NO: 9638 - RNA, 19 nt, Artificial Sequence
  Description of Artificial Sequence: Synthetic oligonucleotide
ggccacauccgccuggcca

SEQ ID NO: 9639 - RNA, 19 nt, Artificial Sequence
  Description of Artificial Sequence: Synthetic oligonucleotide
gccacauccgccuggccga

SEQ ID NO: 9640 - RNA, 19 nt, Artificial Sequence
  Description of Artificial Sequence: Synthetic oligonucleotide
ccacauccgccuggccgaa

SEQ ID NO: 9641 - RNA, 19 nt, Artificial Sequence
  Description of Artificial Sequence: Synthetic oligonucleotide
cacauccgccuggccgaca

SEQ ID NO: 9642 - RNA, 19 nt, Artificial Sequence
  Description of Artificial Sequence: Synthetic oligonucleotide
acauccgccuggccgacua

SEQ ID NO: 9643 - RNA, 19 nt, Artificial Sequence
  Description of Artificial Sequence: Synthetic oligonucleotide
cauccgccuggccgacuua

SEQ ID NO: 9644 - RNA, 19 nt, Artificial Sequence
  Description of Artificial Sequence: Synthetic oligonucleotide
auccgccuggccgacuuca

SEQ ID NO: 9645 - RNA, 19 nt, Artificial Sequence
  Description of Artificial Sequence: Synthetic oligonucleotide
uccgccuggccgacuucga

SEQ ID NO: 9646 - RNA, 19 nt, Artificial Sequence
  Description of Artificial Sequence: Synthetic oligonucleotide
ccgccuggccgacuucgga

SEQ ID NO: 9647 - RNA, 19 nt, Artificial Sequence
  Description of Artificial Sequence: Synthetic oligonucleotide
cgccuggccgacuucggca

SEQ ID NO: 9648 - RNA, 19 nt, Artificial Sequence
  Description of Artificial Sequence: Synthetic oligonucleotide
gccuggccgacuucggcua

SEQ ID NO: 9649 - RNA, 19 nt, Artificial Sequence
  Description of Artificial Sequence: Synthetic oligonucleotide
ccuggccgacuucggcuca

SEQ ID NO: 9650 - RNA, 19 nt, Artificial Sequence
  Description of Artificial Sequence: Synthetic oligonucleotide
cuggccgacuucggcucua

SEQ ID NO: 9651 - RNA, 19 nt, Artificial Sequence
  Description of Artificial Sequence: Synthetic oligonucleotide
uggccgacuucggcucuua

SEQ ID NO: 9652 - RNA, 19 nt, Artificial Sequence
  Description of Artificial Sequence: Synthetic oligonucleotide
ggccgacuucggcucuuga

SEQ ID NO: 9653 - RNA, 19 nt, Artificial Sequence
  Description of Artificial Sequence: Synthetic oligonucleotide
gccgacuucggcucuugca

SEQ ID NO: 9654 - RNA, 19 nt, Artificial Sequence
  Description of Artificial Sequence: Synthetic oligonucleotide
ccgacuucggcucuugcca

SEQ ID NO: 9655 - RNA, 19 nt, Artificial Sequence
  Description of Artificial Sequence: Synthetic oligonucleotide
cgacuucggcucuugccua

SEQ ID NO: 9656 - RNA, 19 nt, Artificial Sequence
  Description of Artificial Sequence: Synthetic oligonucleotide
gacuucggcucuugccuca

SEQ ID NO: 9657 - RNA, 19 nt, Artificial Sequence
  Description of Artificial Sequence: Synthetic oligonucleotide
acuucggcucuugccucaa

SEQ ID NO: 9658 - RNA, 19 nt, Artificial Sequence
  Description of Artificial Sequence: Synthetic oligonucleotide
cuucggcucuugccucaaa

SEQ ID NO: 9659 - RNA, 19 nt, Artificial Sequence
  Description of Artificial Sequence: Synthetic oligonucleotide
uucggcucuugccucaaga

SEQ ID NO: 9660 - RNA, 19 nt, Artificial Sequence
  Description of Artificial Sequence: Synthetic oligonucleotide
ucggcucuugccucaagca

SEQ ID NO: 9661 - RNA, 19 nt, Artificial Sequence
  Description of Artificial Sequence: Synthetic oligonucleotide
cggcucuugccucaagcua

SEQ ID NO: 9662 - RNA, 19 nt, Artificial Sequence
  Description of Artificial Sequence: Synthetic oligonucleotide
ggcucuugccucaagcuga

SEQ ID NO: 9663 - RNA, 19 nt, Artificial Sequence
  Description of Artificial Sequence: Synthetic oligonucleotide
gcucuugccucaagcugca

SEQ ID NO: 9664 - RNA, 19 nt, Artificial Sequence
  Description of Artificial Sequence: Synthetic oligonucleotide
cucuugccucaagcugcga

SEQ ID NO: 9665 - RNA, 19 nt, Artificial Sequence
  Description of Artificial Sequence: Synthetic oligonucleotide
ucuugccucaagcugcgga

SEQ ID NO: 9666 - RNA, 19 nt, Artificial Sequence
  Description of Artificial Sequence: Synthetic oligonucleotide
cuugccucaagcugcggga

SEQ ID NO: 9667 - RNA, 19 nt, Artificial Sequence
  Description of Artificial Sequence: Synthetic oligonucleotide
uugccucaagcugcgggca

SEQ ID NO: 9668 - RNA, 19 nt, Artificial Sequence
  Description of Artificial Sequence: Synthetic oligonucleotide
ugccucaagcugcgggcaa

SEQ ID NO: 9669 - RNA, 19 nt, Artificial Sequence
  Description of Artificial Sequence: Synthetic oligonucleotide
gccucaagcugcgggcaga

SEQ ID NO: 9670 - RNA, 19 nt, Artificial Sequence
  Description of Artificial Sequence: Synthetic oligonucleotide
ccucaagcugcgggcagaa

SEQ ID NO: 9671 - RNA, 19 nt, Artificial Sequence
  Description of Artificial Sequence: Synthetic oligonucleotide
cucaagcugcgggcagaua

SEQ ID NO: 9672 - RNA, 19 nt, Artificial Sequence
  Description of Artificial Sequence: Synthetic oligonucleotide
ucaagcugcgggcagauga

SEQ ID NO: 9673 - RNA, 19 nt, Artificial Sequence
  Description of Artificial Sequence: Synthetic oligonucleotide
caagcugcgggcagaugga

SEQ ID NO: 9674 - RNA, 19 nt, Artificial Sequence
  Description of Artificial Sequence: Synthetic oligonucleotide
aagcugcgggcagauggaa

SEQ ID NO: 9675 - RNA, 19 nt, Artificial Sequence
  Description of Artificial Sequence: Synthetic oligonucleotide
agcugcgggcagauggaaa

SEQ ID NO: 9676 - RNA, 19 nt, Artificial Sequence
  Description of Artificial Sequence: Synthetic oligonucleotide
gcugcgggcagauggaaca

SEQ ID NO: 9677 - RNA, 19 nt, Artificial Sequence
  Description of Artificial Sequence: Synthetic oligonucleotide
cugcgggcagauggaacga

SEQ ID NO: 9678 - RNA, 19 nt, Artificial Sequence
  Description of Artificial Sequence: Synthetic oligonucleotide
ugcgggcagauggaacgga

SEQ ID NO: 9679 - RNA, 19 nt, Artificial Sequence
  Description of Artificial Sequence: Synthetic oligonucleotide
gcgggcagauggaacggua

SEQ ID NO: 9680 - RNA, 19 nt, Artificial Sequence
  Description of Artificial Sequence: Synthetic oligonucleotide
cgggcagauggaacgguga

SEQ ID NO: 9681 - RNA, 19 nt, Artificial Sequence
  Description of Artificial Sequence: Synthetic oligonucleotide
gggcagauggaacggugca

SEQ ID NO: 9682 - RNA, 19 nt, Artificial Sequence
  Description of Artificial Sequence: Synthetic oligonucleotide
ggcagauggaacggugcga

SEQ ID NO: 9683 - RNA, 19 nt, Artificial Sequence
  Description of Artificial Sequence: Synthetic oligonucleotide
gcagauggaacggugcgga

SEQ ID NO: 9684 - RNA, 19 nt, Artificial Sequence
  Description of Artificial Sequence: Synthetic oligonucleotide
cagauggaacggugcggua

SEQ ID NO: 9685 - RNA, 19 nt, Artificial Sequence
  Description of Artificial Sequence: Synthetic oligonucleotide
agauggaacggugcgguca

SEQ ID NO: 9686 - RNA, 19 nt, Artificial Sequence
  Description of Artificial Sequence: Synthetic oligonucleotide
gauggaacggugcggucga

SEQ ID NO: 9687 - RNA, 19 nt, Artificial Sequence
  Description of Artificial Sequence: Synthetic oligonucleotide
auggaacggugcggucgca

SEQ ID NO: 9688 - RNA, 19 nt, Artificial Sequence
  Description of Artificial Sequence: Synthetic oligonucleotide
uggaacggugcggucgcua

SEQ ID NO: 9689 - RNA, 19 nt, Artificial Sequence
  Description of Artificial Sequence: Synthetic oligonucleotide
ggaacggugcggucgcuga

SEQ ID NO: 9690 - RNA, 19 nt, Artificial Sequence
  Description of Artificial Sequence: Synthetic oligonucleotide
gaacggugcggucgcugga

SEQ ID NO: 9691 - RNA, 19 nt, Artificial Sequence
  Description of Artificial Sequence: Synthetic oligonucleotide
aacggugcggucgcuggua

SEQ ID NO: 9692 - RNA, 19 nt, Artificial Sequence
  Description of Artificial Sequence: Synthetic oligonucleotide
acggugcggucgcugguga

SEQ ID NO: 9693 - RNA, 19 nt, Artificial Sequence
  Description of Artificial Sequence: Synthetic oligonucleotide
cggugcggucgcuggugga

SEQ ID NO: 9694 - RNA, 19 nt, Artificial Sequence
  Description of Artificial Sequence: Synthetic oligonucleotide
ggugcggucgcugguggca

SEQ ID NO: 9695 - RNA, 19 nt, Artificial Sequence
  Description of Artificial Sequence: Synthetic oligonucleotide
gugcggucgcugguggcua

SEQ ID NO: 9696 - RNA, 19 nt, Artificial Sequence
  Description of Artificial Sequence: Synthetic oligonucleotide
ugcggucgcugguggcuga

SEQ ID NO: 9697 - RNA, 19 nt, Artificial Sequence
  Description of Artificial Sequence: Synthetic oligonucleotide
gcggucgcugguggcugua

SEQ ID NO: 9698 - RNA, 19 nt, Artificial Sequence
  Description of Artificial Sequence: Synthetic oligonucleotide
cggucgcugguggcuguga

SEQ ID NO: 9699 - RNA, 19 nt, Artificial Sequence
  Description of Artificial Sequence: Synthetic oligonucleotide
ggucgcugguggcugugga

SEQ ID NO: 9700 - RNA, 19 nt, Artificial Sequence
  Description of Artificial Sequence: Synthetic oligonucleotide
gucgcugguggcuguggga

SEQ ID NO: 9701 - RNA, 19 nt, Artificial Sequence
  Description of Artificial Sequence: Synthetic oligonucleotide
ucgcugguggcugugggca

SEQ ID NO: 9702 - RNA, 19 nt, Artificial Sequence
  Description of Artificial Sequence: Synthetic oligonucleotide
cgcugguggcugugggcaa

SEQ ID NO: 9703 - RNA, 19 nt, Artificial Sequence
  Description of Artificial Sequence: Synthetic oligonucleotide
gcugguggcugugggcaca

SEQ ID NO: 9704 - RNA, 19 nt, Artificial Sequence
  Description of Artificial Sequence: Synthetic oligonucleotide
cugguggcugugggcacca

SEQ ID NO: 9705 - RNA, 19 nt, Artificial Sequence
  Description of Artificial Sequence: Synthetic oligonucleotide
ugguggcugugggcaccca

SEQ ID NO: 9706 - RNA, 19 nt, Artificial Sequence
  Description of Artificial Sequence: Synthetic oligonucleotide
gguggcugugggcacccca

SEQ ID NO: 9707 - RNA, 19 nt, Artificial Sequence
  Description of Artificial Sequence: Synthetic oligonucleotide
guggcugugggcaccccaa

SEQ ID NO: 9708 - RNA, 19 nt, Artificial Sequence
  Description of Artificial Sequence: Synthetic oligonucleotide
uggcugugggcaccccaga

SEQ ID NO: 9709 - RNA, 19 nt, Artificial Sequence
  Description of Artificial Sequence: Synthetic oligonucleotide
ggcugugggcaccccagaa

SEQ ID NO: 9710 - RNA, 19 nt, Artificial Sequence
  Description of Artificial Sequence: Synthetic oligonucleotide
gcugugggcaccccagaca

SEQ ID NO: 9711 - RNA, 19 nt, Artificial Sequence
  Description of Artificial Sequence: Synthetic oligonucleotide
cugugggcaccccagacua

SEQ ID NO: 9712 - RNA, 19 nt, Artificial Sequence
  Description of Artificial Sequence: Synthetic oligonucleotide
ugugggcaccccagacuaa

SEQ ID NO: 9713 - RNA, 19 nt, Artificial Sequence
  Description of Artificial Sequence: Synthetic oligonucleotide
gugggcaccccagacuaca

SEQ ID NO: 9714 - RNA, 19 nt, Artificial Sequence
  Description of Artificial Sequence: Synthetic oligonucleotide
ugggcaccccagacuacca

SEQ ID NO: 9715 - RNA, 19 nt, Artificial Sequence
  Description of Artificial Sequence: Synthetic oligonucleotide
gggcaccccagacuaccua

SEQ ID NO: 9716 - RNA, 19 nt, Artificial Sequence
  Description of Artificial Sequence: Synthetic oligonucleotide
ggcaccccagacuaccuga

SEQ ID NO: 9717 - RNA, 19 nt, Artificial Sequence
  Description of Artificial Sequence: Synthetic oligonucleotide
gcaccccagacuaccugua

SEQ ID NO: 9718 - RNA, 19 nt, Artificial Sequence
  Description of Artificial Sequence: Synthetic oligonucleotide
caccccagacuaccuguca

SEQ ID NO: 9719 - RNA, 19 nt, Artificial Sequence
  Description of Artificial Sequence: Synthetic oligonucleotide
accccagacuaccugucca

SEQ ID NO: 9720 - RNA, 19 nt, Artificial Sequence
  Description of Artificial Sequence: Synthetic oligonucleotide
ccccagacuaccuguccca

SEQ ID NO: 9721 - RNA, 19 nt, Artificial Sequence
  Description of Artificial Sequence: Synthetic oligonucleotide
cccagacuaccugucccca

SEQ ID NO: 9722 - RNA, 19 nt, Artificial Sequence
  Description of Artificial Sequence: Synthetic oligonucleotide
ccagacuaccuguccccca

SEQ ID NO: 9723 - RNA, 19 nt, Artificial Sequence
  Description of Artificial Sequence: Synthetic oligonucleotide
cagacuaccugucccccga

SEQ ID NO: 9724 - RNA, 19 nt, Artificial Sequence
  Description of Artificial Sequence: Synthetic oligonucleotide
agacuaccugucccccgaa

SEQ ID NO: 9725 - RNA, 19 nt, Artificial Sequence
  Description of Artificial Sequence: Synthetic oligonucleotide
gacuaccugucccccgaga

SEQ ID NO: 9726 - RNA, 19 nt, Artificial Sequence
  Description of Artificial Sequence: Synthetic oligonucleotide
acuaccugucccccgagaa

SEQ ID NO: 9727 - RNA, 19 nt, Artificial Sequence
  Description of Artificial Sequence: Synthetic oligonucleotide
cuaccugucccccgagaua

SEQ ID NO: 9728 - RNA, 19 nt, Artificial Sequence
  Description of Artificial Sequence: Synthetic oligonucleotide
uaccugucccccgagauca

SEQ ID NO: 9729 - RNA, 19 nt, Artificial Sequence
  Description of Artificial Sequence: Synthetic oligonucleotide
accugucccccgagaucca

SEQ ID NO: 9730 - RNA, 19 nt, Artificial Sequence
  Description of Artificial Sequence: Synthetic oligonucleotide
ccugucccccgagauccua

SEQ ID NO: 9731 - RNA, 19 nt, Artificial Sequence
  Description of Artificial Sequence: Synthetic oligonucleotide
cugucccccgagauccuga

SEQ ID NO: 9732 - RNA, 19 nt, Artificial Sequence
  Description of Artificial Sequence: Synthetic oligonucleotide
ugucccccgagauccugca

SEQ ID NO: 9733 - RNA, 19 nt, Artificial Sequence
  Description of Artificial Sequence: Synthetic oligonucleotide
gucccccgagauccugcaa

SEQ ID NO: 9734 - RNA, 19 nt, Artificial Sequence
  Description of Artificial Sequence: Synthetic oligonucleotide
ucccccgagauccugcaga

SEQ ID NO: 9735 - RNA, 19 nt, Artificial Sequence
  Description of Artificial Sequence: Synthetic oligonucleotide
cccccgagauccugcagga

SEQ ID NO: 9736 - RNA, 19 nt, Artificial Sequence
  Description of Artificial Sequence: Synthetic oligonucleotide
ccccgagauccugcaggca

SEQ ID NO: 9737 - RNA, 19 nt, Artificial Sequence
  Description of Artificial Sequence: Synthetic oligonucleotide
cccgagauccugcaggcua

SEQ ID NO: 9738 - RNA, 19 nt, Artificial Sequence
  Description of Artificial Sequence: Synthetic oligonucleotide
ccgagauccugcaggcuga

SEQ ID NO: 9739 - RNA, 19 nt, Artificial Sequence
  Description of Artificial Sequence: Synthetic oligonucleotide
cgagauccugcaggcugua

SEQ ID NO: 9740 - RNA, 19 nt, Artificial Sequence
  Description of Artificial Sequence: Synthetic oligonucleotide
gagauccugcaggcuguga

SEQ ID NO: 9741 - RNA, 19 nt, Artificial Sequence
  Description of Artificial Sequence: Synthetic oligonucleotide
agauccugcaggcugugga

SEQ ID NO: 9742 - RNA, 19 nt, Artificial Sequence
  Description of Artificial Sequence: Synthetic oligonucleotide
gauccugcaggcuguggga

SEQ ID NO: 9743 - RNA, 19 nt, Artificial Sequence
  Description of Artificial Sequence: Synthetic oligonucleotide
auccugcaggcugugggca

SEQ ID NO: 9744 - RNA, 19 nt, Artificial Sequence
  Description of Artificial Sequence: Synthetic oligonucleotide
uccugcaggcugugggcga

SEQ ID NO: 9745 - RNA, 19 nt, Artificial Sequence
  Description of Artificial Sequence: Synthetic oligonucleotide
ccugcaggcugugggcgga

SEQ ID NO: 9746 - RNA, 19 nt, Artificial Sequence
  Description of Artificial Sequence: Synthetic oligonucleotide
cugcaggcugugggcggua

SEQ ID NO: 9747 - RNA, 19 nt, Artificial Sequence
  Description of Artificial Sequence: Synthetic oligonucleotide
ugcaggcugugggcgguga

SEQ ID NO: 9748 - RNA, 19 nt, Artificial Sequence
  Description of Artificial Sequence: Synthetic oligonucleotide
gcaggcugugggcggugga

SEQ ID NO: 9749 - RNA, 19 nt, Artificial Sequence
  Description of Artificial Sequence: Synthetic oligonucleotide
caggcugugggcgguggga

SEQ ID NO: 9750 - RNA, 19 nt, Artificial Sequence
  Description of Artificial Sequence: Synthetic oligonucleotide
aggcugugggcggugggca

SEQ ID NO: 9751 - RNA, 19 nt, Artificial Sequence
  Description of Artificial Sequence: Synthetic oligonucleotide
ggcugugggcggugggcca

SEQ ID NO: 9752 - RNA, 19 nt, Artificial Sequence
  Description of Artificial Sequence: Synthetic oligonucleotide
gcugugggcggugggccua

SEQ ID NO: 9753 - RNA, 19 nt, Artificial Sequence
  Description of Artificial Sequence: Synthetic oligonucleotide
cugugggcggugggccuga

SEQ ID NO: 9754 - RNA, 19 nt, Artificial Sequence
  Description of Artificial Sequence: Synthetic oligonucleotide
ugugggcggugggccugga

SEQ ID NO: 9755 - RNA, 19 nt, Artificial Sequence
  Description of Artificial Sequence: Synthetic oligonucleotide
gugggcggugggccuggga

SEQ ID NO: 9756 - RNA, 19 nt, Artificial Sequence
  Description of Artificial Sequence: Synthetic oligonucleotide
ugggcggugggccugggaa

SEQ ID NO: 9757 - RNA, 19 nt, Artificial Sequence
  Description of Artificial Sequence: Synthetic oligonucleotide
gggcggugggccugggaca

SEQ ID NO: 9758 - RNA, 19 nt, Artificial Sequence
  Description of Artificial Sequence: Synthetic oligonucleotide
ggcggugggccugggacaa

SEQ ID NO: 9759 - RNA, 19 nt, Artificial Sequence
  Description of Artificial Sequence: Synthetic oligonucleotide
gcggugggccugggacaga

SEQ ID NO: 9760 - RNA, 19 nt, Artificial Sequence
  Description of Artificial Sequence: Synthetic oligonucleotide
cggugggccugggacagga

SEQ ID NO: 9761 - RNA, 19 nt, Artificial Sequence
  Description of Artificial Sequence: Synthetic oligonucleotide
ggugggccugggacaggca

SEQ ID NO: 9762 - RNA, 19 nt, Artificial Sequence
  Description of Artificial Sequence: Synthetic oligonucleotide
gugggccugggacaggcaa

SEQ ID NO: 9763 - RNA, 19 nt, Artificial Sequence
  Description of Artificial Sequence: Synthetic oligonucleotide
ugggccugggacaggcaga

SEQ ID NO: 9764 - RNA, 19 nt, Artificial Sequence
  Description of Artificial Sequence: Synthetic oligonucleotide
gggccugggacaggcagca

SEQ ID NO: 9765 - RNA, 19 nt, Artificial Sequence
  Description of Artificial Sequence: Synthetic oligonucleotide
ggccugggacaggcagcua

SEQ ID NO: 9766 - RNA, 19 nt, Artificial Sequence
  Description of Artificial Sequence: Synthetic oligonucleotide
gccugggacaggcagcuaa

SEQ ID NO: 9767 - RNA, 19 nt, Artificial Sequence
  Description of Artificial Sequence: Synthetic oligonucleotide
ccugggacaggcagcuaca

SEQ ID NO: 9768 - RNA, 19 nt, Artificial Sequence
  Description of Artificial Sequence: Synthetic oligonucleotide
cugggacaggcagcuacga

SEQ ID NO: 9769 - RNA, 19 nt, Artificial Sequence
  Description of Artificial Sequence: Synthetic oligonucleotide
ugggacaggcagcuacgga

SEQ ID NO: 9770 - RNA, 19 nt, Artificial Sequence
  Description of Artificial Sequence: Synthetic oligonucleotide
gggacaggcagcuacggga

SEQ ID NO: 9771 - RNA, 19 nt, Artificial Sequence
  Description of Artificial Sequence: Synthetic oligonucleotide
ggacaggcagcuacgggca

SEQ ID NO: 9772 - RNA, 19 nt, Artificial Sequence
  Description of Artificial Sequence: Synthetic oligonucleotide
gacaggcagcuacgggcca

SEQ ID NO: 9773 - RNA, 19 nt, Artificial Sequence
  Description of Artificial Sequence: Synthetic oligonucleotide
acaggcagcuacgggccca

SEQ ID NO: 9774 - RNA, 19 nt, Artificial Sequence
  Description of Artificial Sequence: Synthetic oligonucleotide
caggcagcuacgggcccga

SEQ ID NO: 9775 - RNA, 19 nt, Artificial Sequence
  Description of Artificial Sequence: Synthetic oligonucleotide
aggcagcuacgggcccgaa

SEQ ID NO: 9776 - RNA, 19 nt, Artificial Sequence
  Description of Artificial Sequence: Synthetic oligonucleotide
ggcagcuacgggcccgaga

SEQ ID NO: 9777 - RNA, 19 nt, Artificial Sequence
  Description of Artificial Sequence: Synthetic oligonucleotide
gcagcuacgggcccgagua

SEQ ID NO: 9778 - RNA, 19 nt, Artificial Sequence
  Description of Artificial Sequence: Synthetic oligonucleotide
cagcuacgggcccgaguga

SEQ ID NO: 9779 - RNA, 19 nt, Artificial Sequence
  Description of Artificial Sequence: Synthetic oligonucleotide
agcuacgggcccgagugua

SEQ ID NO: 9780 - RNA, 19 nt, Artificial Sequence
  Description of Artificial Sequence: Synthetic oligonucleotide
gcuacgggcccgaguguga

SEQ ID NO: 9781 - RNA, 19 nt, Artificial Sequence
  Description of Artificial Sequence: Synthetic oligonucleotide
cuacgggcccgagugugaa

SEQ ID NO: 9782 - RNA, 19 nt, Artificial Sequence
  Description of Artificial Sequence: Synthetic oligonucleotide
uacgggcccgagugugaca

SEQ ID NO: 9783 - RNA, 19 nt, Artificial Sequence
  Description of Artificial Sequence: Synthetic oligonucleotide
acgggcccgagugugacua

SEQ ID NO: 9784 - RNA, 19 nt, Artificial Sequence
  Description of Artificial Sequence: Synthetic oligonucleotide
cgggcccgagugugacuga

SEQ ID NO: 9785 - RNA, 19 nt, Artificial Sequence
  Description of Artificial Sequence: Synthetic oligonucleotide
gggcccgagugugacugga

SEQ ID NO: 9786 - RNA, 19 nt, Artificial Sequence
  Description of Artificial Sequence: Synthetic oligonucleotide
ggcccgagugugacuggua

SEQ ID NO: 9787 - RNA, 19 nt, Artificial Sequence
  Description of Artificial Sequence: Synthetic oligonucleotide
gcccgagugugacugguga

SEQ ID NO: 9788 - RNA, 19 nt, Artificial Sequence
  Description of Artificial Sequence: Synthetic oligonucleotide
cccgagugugacuggugga

SEQ ID NO: 9789 - RNA, 19 nt, Artificial Sequence
  Description of Artificial Sequence: Synthetic oligonucleotide
ccgagugugacugguggga

SEQ ID NO: 9790 - RNA, 19 nt, Artificial Sequence
  Description of Artificial Sequence: Synthetic oligonucleotide
cgagugugacuggugggca

SEQ ID NO: 9791 - RNA, 19 nt, Artificial Sequence
  Description of Artificial Sequence: Synthetic oligonucleotide
gagugugacuggugggcga

SEQ ID NO: 9792 - RNA, 19 nt, Artificial Sequence
  Description of Artificial Sequence: Synthetic oligonucleotide
agugugacuggugggcgca

SEQ ID NO: 9793 - RNA, 19 nt, Artificial Sequence
  Description of Artificial Sequence: Synthetic oligonucleotide
gugugacuggugggcgcua

SEQ ID NO: 9794 - RNA, 19 nt, Artificial Sequence
  Description of Artificial Sequence: Synthetic oligonucleotide
ugugacuggugggcgcuga

SEQ ID NO: 9795 - RNA, 19 nt, Artificial Sequence
  Description of Artificial Sequence: Synthetic oligonucleotide
gugacuggugggcgcugga

SEQ ID NO: 9796 - RNA, 19 nt, Artificial Sequence
  Description of Artificial Sequence: Synthetic oligonucleotide
ugacuggugggcgcuggga

SEQ ID NO: 9797 - RNA, 19 nt, Artificial Sequence
  Description of Artificial Sequence: Synthetic oligonucleotide
gacuggugggcgcugggua

SEQ ID NO: 9798 - RNA, 19 nt, Artificial Sequence
  Description of Artificial Sequence: Synthetic oligonucleotide
acuggugggcgcuggguga

SEQ ID NO: 9799 - RNA, 19 nt, Artificial Sequence
  Description of Artificial Sequence: Synthetic oligonucleotide
cuggugggcgcugggugua

SEQ ID NO: 9800 - RNA, 19 nt, Artificial Sequence
  Description of Artificial Sequence: Synthetic oligonucleotide
uggugggcgcuggguguaa

SEQ ID NO: 9801 - RNA, 19 nt, Artificial Sequence
  Description of Artificial Sequence: Synthetic oligonucleotide
ggugggcgcuggguguaua

SEQ ID NO: 9802 - RNA, 19 nt, Artificial Sequence
  Description of Artificial Sequence: Synthetic oligonucleotide
gugggcgcuggguguauua

SEQ ID NO: 9803 - RNA, 19 nt, Artificial Sequence
  Description of Artificial Sequence: Synthetic oligonucleotide
ugggcgcuggguguauuca

SEQ ID NO: 9804 - RNA, 19 nt, Artificial Sequence
  Description of Artificial Sequence: Synthetic oligonucleotide
gggcgcuggguguauucga

SEQ ID NO: 9805 - RNA, 19 nt, Artificial Sequence
  Description of Artificial Sequence: Synthetic oligonucleotide
ggcgcuggguguauucgca

SEQ ID NO: 9806 - RNA, 19 nt, Artificial Sequence
  Description of Artificial Sequence: Synthetic oligonucleotide
gcgcuggguguauucgcca

SEQ ID NO: 9807 - RNA, 19 nt, Artificial Sequence
  Description of Artificial Sequence: Synthetic oligonucleotide
cgcuggguguauucgccua

SEQ ID NO: 9808 - RNA, 19 nt, Artificial Sequence
  Description of Artificial Sequence: Synthetic oligonucleotide
gcuggguguauucgccuaa

SEQ ID NO: 9809 - RNA, 19 nt, Artificial Sequence
  Description of Artificial Sequence: Synthetic oligonucleotide
cuggguguauucgccuaua

SEQ ID NO: 9810 - RNA, 19 nt, Artificial Sequence
  Description of Artificial Sequence: Synthetic oligonucleotide
uggguguauucgccuauga

SEQ ID NO: 9811 - RNA, 19 nt, Artificial Sequence
  Description of Artificial Sequence: Synthetic oligonucleotide
ggguguauucgccuaugaa

SEQ ID NO: 9812 - RNA, 19 nt, Artificial Sequence
  Description of Artificial Sequence: Synthetic oligonucleotide
gguguauucgccuaugaaa

SEQ ID NO: 9813 - RNA, 19 nt, Artificial Sequence
  Description of Artificial Sequence: Synthetic oligonucleotide
guguauucgccuaugaaaa

SEQ ID NO: 9814 - RNA, 19 nt, Artificial Sequence
  Description of Artificial Sequence: Synthetic oligonucleotide
uguauucgccuaugaaaua

SEQ ID NO: 9815 - RNA, 19 nt, Artificial Sequence
  Description of Artificial Sequence: Synthetic oligonucleotide
guauucgccuaugaaauga

SEQ ID NO: 9816 - RNA, 19 nt, Artificial Sequence
  Description of Artificial Sequence: Synthetic oligonucleotide
uauucgccuaugaaaugua

SEQ ID NO: 9817 - RNA, 19 nt, Artificial Sequence
  Description of Artificial Sequence: Synthetic oligonucleotide
auucgccuaugaaauguua

SEQ ID NO: 9818 - RNA, 19 nt, Artificial Sequence
  Description of Artificial Sequence: Synthetic oligonucleotide
uucgccuaugaaauguuca

SEQ ID NO: 9819 - RNA, 19 nt, Artificial Sequence
  Description of Artificial Sequence: Synthetic oligonucleotide
ucgccuaugaaauguucua

SEQ ID NO: 9820 - RNA, 19 nt, Artificial Sequence
  Description of Artificial Sequence: Synthetic oligonucleotide
cgccuaugaaauguucuaa

SEQ ID NO: 9821 - RNA, 19 nt, Artificial Sequence
  Description of Artificial Sequence: Synthetic oligonucleotide
gccuaugaaauguucuaua

SEQ ID NO: 9822 - RNA, 19 nt, Artificial Sequence
  Description of Artificial Sequence: Synthetic oligonucleotide
ccuaugaaauguucuauga

SEQ ID NO: 9823 - RNA, 19 nt, Artificial Sequence
  Description of Artificial Sequence: Synthetic oligonucleotide
cuaugaaauguucuaugga

SEQ ID NO: 9824 - RNA, 19 nt, Artificial Sequence
  Description of Artificial Sequence: Synthetic oligonucleotide
uaugaaauguucuauggga

SEQ ID NO: 9825 - RNA, 19 nt, Artificial Sequence
  Description of Artificial Sequence: Synthetic oligonucleotide
augaaauguucuaugggca

SEQ ID NO: 9826 - RNA, 19 nt, Artificial Sequence
  Description of Artificial Sequence: Synthetic oligonucleotide
ugaaauguucuaugggcaa

SEQ ID NO: 9827 - RNA, 19 nt, Artificial Sequence
  Description of Artificial Sequence: Synthetic oligonucleotide
gaaauguucuaugggcaga

SEQ ID NO: 9828 - RNA, 19 nt, Artificial Sequence
  Description of Artificial Sequence: Synthetic oligonucleotide
aaauguucuaugggcagaa

SEQ ID NO: 9829 - RNA, 19 nt, Artificial Sequence
  Description of Artificial Sequence: Synthetic oligonucleotide
aauguucuaugggcagaca

SEQ ID NO: 9830 - RNA, 19 nt, Artificial Sequence
  Description of Artificial Sequence: Synthetic oligonucleotide
auguucuaugggcagacga

SEQ ID NO: 9831 - RNA, 19 nt, Artificial Sequence
  Description of Artificial Sequence: Synthetic oligonucleotide
uguucuaugggcagacgca

SEQ ID NO: 9832 - RNA, 19 nt, Artificial Sequence
  Description of Artificial Sequence: Synthetic oligonucleotide
guucuaugggcagacgcca

SEQ ID NO: 9833 - RNA, 19 nt, Artificial Sequence
  Description of Artificial Sequence: Synthetic oligonucleotide
uucuaugggcagacgccca

SEQ ID NO: 9834 - RNA, 19 nt, Artificial Sequence
  Description of Artificial Sequence: Synthetic oligonucleotide
ucuaugggcagacgcccua

SEQ ID NO: 9835 - RNA, 19 nt, Artificial Sequence
  Description of Artificial Sequence: Synthetic oligonucleotide
cuaugggcagacgcccuua

SEQ ID NO: 9836 - RNA, 19 nt, Artificial Sequence
  Description of Artificial Sequence: Synthetic oligonucleotide
uaugggcagacgcccuuca

SEQ ID NO: 9837 - RNA, 19 nt, Artificial Sequence
  Description of Artificial Sequence: Synthetic oligonucleotide
augggcagacgcccuucua

SEQ ID NO: 9838 - RNA, 19 nt, Artificial Sequence
  Description of Artificial Sequence: Synthetic oligonucleotide
ugggcagacgcccuucuaa

SEQ ID NO: 9839 - RNA, 19 nt, Artificial Sequence
  Description of Artificial Sequence: Synthetic oligonucleotide
gggcagacgcccuucuaca

SEQ ID NO: 9840 - RNA, 19 nt, Artificial Sequence
  Description of Artificial Sequence: Synthetic oligonucleotide
ggcagacgcccuucuacga

SEQ ID NO: 9841 - RNA, 19 nt, Artificial Sequence
  Description of Artificial Sequence: Synthetic oligonucleotide
gcagacgcccuucuacgca

SEQ ID NO: 9842 - RNA, 19 nt, Artificial Sequence
  Description of Artificial Sequence: Synthetic oligonucleotide
cagacgcccuucuacgcga

SEQ ID NO: 9843 - RNA, 19 nt, Artificial Sequence
  Description of Artificial Sequence: Synthetic oligonucleotide
agacgcccuucuacgcgga

SEQ ID NO: 9844 - RNA, 19 nt, Artificial Sequence
  Description of Artificial Sequence: Synthetic oligonucleotide
gacgcccuucuacgcggaa

SEQ ID NO: 9845 - RNA, 19 nt, Artificial Sequence
  Description of Artificial Sequence: Synthetic oligonucleotide
acgcccuucuacgcggaua

SEQ ID NO: 9846 - RNA, 19 nt, Artificial Sequence
  Description of Artificial Sequence: Synthetic oligonucleotide
cgcccuucuacgcggauua

SEQ ID NO: 9847 - RNA, 19 nt, Artificial Sequence
  Description of Artificial Sequence: Synthetic oligonucleotide
gcccuucuacgcggauuca

SEQ ID NO: 9848 - RNA, 19 nt, Artificial Sequence
  Description of Artificial Sequence: Synthetic oligonucleotide
cccuucuacgcggauucca

SEQ ID NO: 9849 - RNA, 19 nt, Artificial Sequence
  Description of Artificial Sequence: Synthetic oligonucleotide
ccuucuacgcggauuccaa

SEQ ID NO: 9850 - RNA, 19 nt, Artificial Sequence
  Description of Artificial Sequence: Synthetic oligonucleotide
cuucuacgcggauuccaca

SEQ ID NO: 9851 - RNA, 19 nt, Artificial Sequence
  Description of Artificial Sequence: Synthetic oligonucleotide
uucuacgcggauuccacga

SEQ ID NO: 9852 - RNA, 19 nt, Artificial Sequence
  Description of Artificial Sequence: Synthetic oligonucleotide
ucuacgcggauuccacgga

SEQ ID NO: 9853 - RNA, 19 nt, Artificial Sequence
  Description of Artificial Sequence: Synthetic oligonucleotide
cuacgcggauuccacggca

SEQ ID NO: 9854 - RNA, 19 nt, Artificial Sequence
  Description of Artificial Sequence: Synthetic oligonucleotide
uacgcggauuccacggcga

SEQ ID NO: 9855 - RNA, 19 nt, Artificial Sequence
  Description of Artificial Sequence: Synthetic oligonucleotide
acgcggauuccacggcgga

SEQ ID NO: 9856 - RNA, 19 nt, Artificial Sequence
  Description of Artificial Sequence: Synthetic oligonucleotide
cgcggauuccacggcggaa

SEQ ID NO: 9857 - RNA, 19 nt, Artificial Sequence
  Description of Artificial Sequence: Synthetic oligonucleotide
gcggauuccacggcggaga

SEQ ID NO: 9858 - RNA, 19 nt, Artificial Sequence
  Description of Artificial Sequence: Synthetic oligonucleotide
cggauuccacggcggagaa

SEQ ID NO: 9859 - RNA, 19 nt, Artificial Sequence
  Description of Artificial Sequence: Synthetic oligonucleotide
ggauuccacggcggagaca

SEQ ID NO: 9860 - RNA, 19 nt, Artificial Sequence
  Description of Artificial Sequence: Synthetic oligonucleotide
gauuccacggcggagacca

SEQ ID NO: 9861 - RNA, 19 nt, Artificial Sequence
  Description of Artificial Sequence: Synthetic oligonucleotide
auuccacggcggagaccua

SEQ ID NO: 9862 - RNA, 19 nt, Artificial Sequence
  Description of Artificial Sequence: Synthetic oligonucleotide
uuccacggcggagaccuaa

SEQ ID NO: 9863 - RNA, 19 nt, Artificial Sequence
  Description of Artificial Sequence: Synthetic oligonucleotide
uccacggcggagaccuaua

SEQ ID NO: 9864 - RNA, 19 nt, Artificial Sequence
  Description of Artificial Sequence: Synthetic oligonucleotide
ccacggcggagaccuauga

SEQ ID NO: 9865 - RNA, 19 nt, Artificial Sequence
  Description of Artificial Sequence: Synthetic oligonucleotide
cacggcggagaccuaugga

SEQ ID NO: 9866 - RNA, 19 nt, Artificial Sequence
  Description of Artificial Sequence: Synthetic oligonucleotide
acggcggagaccuauggca

SEQ ID NO: 9867 - RNA, 19 nt, Artificial Sequence
  Description of Artificial Sequence: Synthetic oligonucleotide
cggcggagaccuauggcaa

SEQ ID NO: 9868 - RNA, 19 nt, Artificial Sequence
  Description of Artificial Sequence: Synthetic oligonucleotide
ggcggagaccuauggcaaa

SEQ ID NO: 9869 - RNA, 19 nt, Artificial Sequence
  Description of Artificial Sequence: Synthetic oligonucleotide
gcggagaccuauggcaaga

SEQ ID NO: 9870 - RNA, 19 nt, Artificial Sequence
  Description of Artificial Sequence: Synthetic oligonucleotide
cggagaccuauggcaagaa

SEQ ID NO: 9871 - RNA, 19 nt, Artificial Sequence
  Description of Artificial Sequence: Synthetic oligonucleotide
ggagaccuauggcaagaua

SEQ ID NO: 9872 - RNA, 19 nt, Artificial Sequence
  Description of Artificial Sequence: Synthetic oligonucleotide
gagaccuauggcaagauca

SEQ ID NO: 9873 - RNA, 19 nt, Artificial Sequence
  Description of Artificial Sequence: Synthetic oligonucleotide
agaccuauggcaagaucga

SEQ ID NO: 9874 - RNA, 19 nt, Artificial Sequence
  Description of Artificial Sequence: Synthetic oligonucleotide
gaccuauggcaagaucgua

SEQ ID NO: 9875 - RNA, 19 nt, Artificial Sequence
  Description of Artificial Sequence: Synthetic oligonucleotide
accuauggcaagaucguca

SEQ ID NO: 9876 - RNA, 19 nt, Artificial Sequence
  Description of Artificial Sequence: Synthetic oligonucleotide
ccuauggcaagaucgucca

SEQ ID NO: 9877 - RNA, 19 nt, Artificial Sequence
  Description of Artificial Sequence: Synthetic oligonucleotide
cuauggcaagaucguccaa

SEQ ID NO: 9878 - RNA, 19 nt, Artificial Sequence
  Description of Artificial Sequence: Synthetic oligonucleotide
uauggcaagaucguccaca

SEQ ID NO: 9879 - RNA, 19 nt, Artificial Sequence
  Description of Artificial Sequence: Synthetic oligonucleotide
auggcaagaucguccacua

SEQ ID NO: 9880 - RNA, 19 nt, Artificial Sequence
  Description of Artificial Sequence: Synthetic oligonucleotide
uggcaagaucguccacuaa

SEQ ID NO: 9881 - RNA, 19 nt, Artificial Sequence
  Description of Artificial Sequence: Synthetic oligonucleotide
ggcaagaucguccacuaca

SEQ ID NO: 9882 - RNA, 19 nt, Artificial Sequence
  Description of Artificial Sequence: Synthetic oligonucleotide
gcaagaucguccacuacaa

SEQ ID NO: 9883 - RNA, 19 nt, Artificial Sequence
  Description of Artificial Sequence: Synthetic oligonucleotide
caagaucguccacuacaaa

SEQ ID NO: 9884 - RNA, 19 nt, Artificial Sequence
  Description of Artificial Sequence: Synthetic oligonucleotide
aagaucguccacuacaaga

SEQ ID NO: 9885 - RNA, 19 nt, Artificial Sequence
  Description of Artificial Sequence: Synthetic oligonucleotide
agaucguccacuacaagga

SEQ ID NO: 9886 - RNA, 19 nt, Artificial Sequence
  Description of Artificial Sequence: Synthetic oligonucleotide
gaucguccacuacaaggaa

SEQ ID NO: 9887 - RNA, 19 nt, Artificial Sequence
  Description of Artificial Sequence: Synthetic oligonucleotide
aucguccacuacaaggaga

SEQ ID NO: 9888 - RNA, 19 nt, Artificial Sequence
  Description of Artificial Sequence: Synthetic oligonucleotide
ucguccacuacaaggagca

SEQ ID NO: 9889 - RNA, 19 nt, Artificial Sequence
  Description of Artificial Sequence: Synthetic oligonucleotide
cguccacuacaaggagcaa

SEQ ID NO: 9890 - RNA, 19 nt, Artificial Sequence
  Description of Artificial Sequence: Synthetic oligonucleotide
guccacuacaaggagcaca

SEQ ID NO: 9891 - RNA, 19 nt, Artificial Sequence
  Description of Artificial Sequence: Synthetic oligonucleotide
uccacuacaaggagcacca

SEQ ID NO: 9892 - RNA, 19 nt, Artificial Sequence
  Description of Artificial Sequence: Synthetic oligonucleotide
ccacuacaaggagcaccua

SEQ ID NO: 9893 - RNA, 19 nt, Artificial Sequence
  Description of Artificial Sequence: Synthetic oligonucleotide
cacuacaaggagcaccuca

SEQ ID NO: 9894 - RNA, 19 nt, Artificial Sequence
  Description of Artificial Sequence: Synthetic oligonucleotide
acuacaaggagcaccucua

SEQ ID NO: 9895 - RNA, 19 nt, Artificial Sequence
  Description of Artificial Sequence: Synthetic oligonucleotide
cuacaaggagcaccucuca

SEQ ID NO: 9896 - RNA, 19 nt, Artificial Sequence
  Description of Artificial Sequence: Synthetic oligonucleotide
uacaaggagcaccucucua

SEQ ID NO: 9897 - RNA, 19 nt, Artificial Sequence
  Description of Artificial Sequence: Synthetic oligonucleotide
acaaggagcaccucucuca

SEQ ID NO: 9898 - RNA, 19 nt, Artificial Sequence
  Description of Artificial Sequence: Synthetic oligonucleotide
caaggagcaccucucucua

SEQ ID NO: 9899 - RNA, 19 nt, Artificial Sequence
  Description of Artificial Sequence: Synthetic oligonucleotide
aaggagcaccucucucuga

SEQ ID NO: 9900 - RNA, 19 nt, Artificial Sequence
  Description of Artificial Sequence: Synthetic oligonucleotide
aggagcaccucucucugca

SEQ ID NO: 9901 - RNA, 19 nt, Artificial Sequence
  Description of Artificial Sequence: Synthetic oligonucleotide
ggagcaccucucucugcca

SEQ ID NO: 9902 - RNA, 19 nt, Artificial Sequence
  Description of Artificial Sequence: Synthetic oligonucleotide
gagcaccucucucugccga

SEQ ID NO: 9903 - RNA, 19 nt, Artificial Sequence
  Description of Artificial Sequence: Synthetic oligonucleotide
agcaccucucucugccgca

SEQ ID NO: 9904 - RNA, 19 nt, Artificial Sequence
  Description of Artificial Sequence: Synthetic oligonucleotide
gcaccucucucugccgcua

SEQ ID NO: 9905 - RNA, 19 nt, Artificial Sequence
  Description of Artificial Sequence: Synthetic oligonucleotide
caccucucucugccgcuga

SEQ ID NO: 9906 - RNA, 19 nt, Artificial Sequence
  Description of Artificial Sequence: Synthetic oligonucleotide
accucucucugccgcugga

SEQ ID NO: 9907 - RNA, 19 nt, Artificial Sequence
  Description of Artificial Sequence: Synthetic oligonucleotide
ccucucucugccgcuggua

SEQ ID NO: 9908 - RNA, 19 nt, Artificial Sequence
  Description of Artificial Sequence: Synthetic oligonucleotide
cucucucugccgcugguga

SEQ ID NO: 9909 - RNA, 19 nt, Artificial Sequence
  Description of Artificial Sequence: Synthetic oligonucleotide
ucucucugccgcuggugga

SEQ ID NO: 9910 - RNA, 19 nt, Artificial Sequence
  Description of Artificial Sequence: Synthetic oligonucleotide
cucucugccgcugguggaa

SEQ ID NO: 9911 - RNA, 19 nt, Artificial Sequence
  Description of Artificial Sequence: Synthetic oligonucleotide
ucucugccgcugguggaca

SEQ ID NO: 9912 - RNA, 19 nt, Artificial Sequence
  Description of Artificial Sequence: Synthetic oligonucleotide
cucugccgcugguggacga

SEQ ID NO: 9913 - RNA, 19 nt, Artificial Sequence
  Description of Artificial Sequence: Synthetic oligonucleotide
ucugccgcugguggacgaa

SEQ ID NO: 9914 - RNA, 19 nt, Artificial Sequence
  Description of Artificial Sequence: Synthetic oligonucleotide
cugccgcugguggacgaaa

SEQ ID NO: 9915 - RNA, 19 nt, Artificial Sequence
  Description of Artificial Sequence: Synthetic oligonucleotide
ugccgcugguggacgaaga

SEQ ID NO: 9916 - RNA, 19 nt, Artificial Sequence
  Description of Artificial Sequence: Synthetic oligonucleotide
gccgcugguggacgaagga

SEQ ID NO: 9917 - RNA, 19 nt, Artificial Sequence
  Description of Artificial Sequence: Synthetic oligonucleotide
ccgcugguggacgaaggga

SEQ ID NO: 9918 - RNA, 19 nt, Artificial Sequence
  Description of Artificial Sequence: Synthetic oligonucleotide
cgcugguggacgaagggga

SEQ ID NO: 9919 - RNA, 19 nt, Artificial Sequence
  Description of Artificial Sequence: Synthetic oligonucleotide
gcugguggacgaaggggua

SEQ ID NO: 9920 - RNA, 19 nt, Artificial Sequence
  Description of Artificial Sequence: Synthetic oligonucleotide
cugguggacgaagggguca

SEQ ID NO: 9921 - RNA, 19 nt, Artificial Sequence
  Description of Artificial Sequence: Synthetic oligonucleotide
ugguggacgaaggggucca

SEQ ID NO: 9922 - RNA, 19 nt, Artificial Sequence
  Description of Artificial Sequence: Synthetic oligonucleotide
gguggacgaagggguccca

SEQ ID NO: 9923 - RNA, 19 nt, Artificial Sequence
  Description of Artificial Sequence: Synthetic oligonucleotide
guggacgaaggggucccua

SEQ ID NO: 9924 - RNA, 19 nt, Artificial Sequence
  Description of Artificial Sequence: Synthetic oligonucleotide
uggacgaaggggucccuga

SEQ ID NO: 9925 - RNA, 19 nt, Artificial Sequence
  Description of Artificial Sequence: Synthetic oligonucleotide
ggacgaaggggucccugaa

SEQ ID NO: 9926 - RNA, 19 nt, Artificial Sequence
  Description of Artificial Sequence: Synthetic oligonucleotide
gacgaaggggucccugaga

SEQ ID NO: 9927 - RNA, 19 nt, Artificial Sequence
  Description of Artificial Sequence: Synthetic oligonucleotide
acgaaggggucccugagga

SEQ ID NO: 9928 - RNA, 19 nt, Artificial Sequence
  Description of Artificial Sequence: Synthetic oligonucleotide
cgaaggggucccugaggaa

SEQ ID NO: 9929 - RNA, 19 nt, Artificial Sequence
  Description of Artificial Sequence: Synthetic oligonucleotide
gaaggggucccugaggaga

SEQ ID NO: 9930 - RNA, 19 nt, Artificial Sequence
  Description of Artificial Sequence: Synthetic oligonucleotide
aaggggucccugaggagga

SEQ ID NO: 9931 - RNA, 19 nt, Artificial Sequence
  Description of Artificial Sequence: Synthetic oligonucleotide
aggggucccugaggaggca

SEQ ID NO: 9932 - RNA, 19 nt, Artificial Sequence
  Description of Artificial Sequence: Synthetic oligonucleotide
ggggucccugaggaggcua

SEQ ID NO: 9933 - RNA, 19 nt, Artificial Sequence
  Description of Artificial Sequence: Synthetic oligonucleotide
gggucccugaggaggcuca

SEQ ID NO: 9934 - RNA, 19 nt, Artificial Sequence
  Description of Artificial Sequence: Synthetic oligonucleotide
ggucccugaggaggcucga

SEQ ID NO: 9935 - RNA, 19 nt, Artificial Sequence
  Description of Artificial Sequence: Synthetic oligonucleotide
gucccugaggaggcucgaa

SEQ ID NO: 9936 - RNA, 19 nt, Artificial Sequence
  Description of Artificial Sequence: Synthetic oligonucleotide
ucccugaggaggcucgaga

SEQ ID NO: 9937 - RNA, 19 nt, Artificial Sequence
  Description of Artificial Sequence: Synthetic oligonucleotide
cccugaggaggcucgagaa

SEQ ID NO: 9938 - RNA, 19 nt, Artificial Sequence
  Description of Artificial Sequence: Synthetic oligonucleotide
ccugaggaggcucgagaca

SEQ ID NO: 9939 - RNA, 19 nt, Artificial Sequence
  Description of Artificial Sequence: Synthetic oligonucleotide
cugaggaggcucgagacua

SEQ ID NO: 9940 - RNA, 19 nt, Artificial Sequence
  Description of Artificial Sequence: Synthetic oligonucleotide
ugaggaggcucgagacuua

SEQ ID NO: 9941 - RNA, 19 nt, Artificial Sequence
  Description of Artificial Sequence: Synthetic oligonucleotide
gaggaggcucgagacuuca

SEQ ID NO: 9942 - RNA, 19 nt, Artificial Sequence
  Description of Artificial Sequence: Synthetic oligonucleotide
aggaggcucgagacuucaa

SEQ ID NO: 9943 - RNA, 19 nt, Artificial Sequence
  Description of Artificial Sequence: Synthetic oligonucleotide
ggaggcucgagacuucaua

SEQ ID NO: 9944 - RNA, 19 nt, Artificial Sequence
  Description of Artificial Sequence: Synthetic oligonucleotide
gaggcucgagacuucauua

SEQ ID NO: 9945 - RNA, 19 nt, Artificial Sequence
  Description of Artificial Sequence: Synthetic oligonucleotide
aggcucgagacuucauuca

SEQ ID NO: 9946 - RNA, 19 nt, Artificial Sequence
  Description of Artificial Sequence: Synthetic oligonucleotide
ggcucgagacuucauucaa

SEQ ID NO: 9947 - RNA, 19 nt, Artificial Sequence
  Description of Artificial Sequence: Synthetic oligonucleotide
gcucgagacuucauucaga

SEQ ID NO: 9948 - RNA, 19 nt, Artificial Sequence
  Description of Artificial Sequence: Synthetic oligonucleotide
cucgagacuucauucagca

SEQ ID NO: 9949 - RNA, 19 nt, Artificial Sequence
  Description of Artificial Sequence: Synthetic oligonucleotide
ucgagacuucauucagcga

SEQ ID NO: 9950 - RNA, 19 nt, Artificial Sequence
  Description of Artificial Sequence: Synthetic oligonucleotide
cgagacuucauucagcgga

SEQ ID NO: 9951 - RNA, 19 nt, Artificial Sequence
  Description of Artificial Sequence: Synthetic oligonucleotide
gagacuucauucagcggua

SEQ ID NO: 9952 - RNA, 19 nt, Artificial Sequence
  Description of Artificial Sequence: Synthetic oligonucleotide
agacuucauucagcgguua

SEQ ID NO: 9953 - RNA, 19 nt, Artificial Sequence
  Description of Artificial Sequence: Synthetic oligonucleotide
gacuucauucagcgguuga

SEQ ID NO: 9954 - RNA, 19 nt, Artificial Sequence
  Description of Artificial Sequence: Synthetic oligonucleotide
acuucauucagcgguugca

SEQ ID NO: 9955 - RNA, 19 nt, Artificial Sequence
  Description of Artificial Sequence: Synthetic oligonucleotide
cuucauucagcgguugcua

SEQ ID NO: 9956 - RNA, 19 nt, Artificial Sequence
  Description of Artificial Sequence: Synthetic oligonucleotide
uucauucagcgguugcuga

SEQ ID NO: 9957 - RNA, 19 nt, Artificial Sequence
  Description of Artificial Sequence: Synthetic oligonucleotide
ucauucagcgguugcugua

SEQ ID NO: 9958 - RNA, 19 nt, Artificial Sequence
  Description of Artificial Sequence: Synthetic oligonucleotide
cauucagcgguugcuguga

SEQ ID NO: 9959 - RNA, 19 nt, Artificial Sequence
  Description of Artificial Sequence: Synthetic oligonucleotide
auucagcgguugcugugua

SEQ ID NO: 9960 - RNA, 19 nt, Artificial Sequence
  Description of Artificial Sequence: Synthetic oligonucleotide
uucagcgguugcuguguca

SEQ ID NO: 9961 - RNA, 19 nt, Artificial Sequence
  Description of Artificial Sequence: Synthetic oligonucleotide
ucagcgguugcugugucca

SEQ ID NO: 9962 - RNA, 19 nt, Artificial Sequence
  Description of Artificial Sequence: Synthetic oligonucleotide
cagcgguugcuguguccca

SEQ ID NO: 9963 - RNA, 19 nt, Artificial Sequence
  Description of Artificial Sequence: Synthetic oligonucleotide
agcgguugcugugucccca

SEQ ID NO: 9964 - RNA, 19 nt, Artificial Sequence
  Description of Artificial Sequence: Synthetic oligonucleotide
gcgguugcuguguccccca

SEQ ID NO: 9965 - RNA, 19 nt, Artificial Sequence
  Description of Artificial Sequence: Synthetic oligonucleotide
cgguugcugugucccccga

SEQ ID NO: 9966 - RNA, 19 nt, Artificial Sequence
  Description of Artificial Sequence: Synthetic oligonucleotide
gguugcugugucccccgga

SEQ ID NO: 9967 - RNA, 19 nt, Artificial Sequence
  Description of Artificial Sequence: Synthetic oligonucleotide
guugcugugucccccggaa

SEQ ID NO: 9968 - RNA, 19 nt, Artificial Sequence
  Description of Artificial Sequence: Synthetic oligonucleotide
uugcugugucccccggaga

SEQ ID NO: 9969 - RNA, 19 nt, Artificial Sequence
  Description of Artificial Sequence: Synthetic oligonucleotide
ugcugugucccccggagaa

SEQ ID NO: 9970 - RNA, 19 nt, Artificial Sequence
  Description of Artificial Sequence: Synthetic oligonucleotide
gcugugucccccggagaca

SEQ ID NO: 9971 - RNA, 19 nt, Artificial Sequence
  Description of Artificial Sequence: Synthetic oligonucleotide
cugugucccccggagacaa

SEQ ID NO: 9972 - RNA, 19 nt, Artificial Sequence
  Description of Artificial Sequence: Synthetic oligonucleotide
ugugucccccggagacaca

SEQ ID NO: 9973 - RNA, 19 nt, Artificial Sequence
  Description of Artificial Sequence: Synthetic oligonucleotide
gugucccccggagacacga

SEQ ID NO: 9974 - RNA, 19 nt, Artificial Sequence
  Description of Artificial Sequence: Synthetic oligonucleotide
ugucccccggagacacgga

SEQ ID NO: 9975 - RNA, 19 nt, Artificial Sequence
  Description of Artificial Sequence: Synthetic oligonucleotide
gucccccggagacacggca

SEQ ID NO: 9976 - RNA, 19 nt, Artificial Sequence
  Description of Artificial Sequence: Synthetic oligonucleotide
ucccccggagacacggcua

SEQ ID NO: 9977 - RNA, 19 nt, Artificial Sequence
  Description of Artificial Sequence: Synthetic oligonucleotide
cccccggagacacggcuga

SEQ ID NO: 9978 - RNA, 19 nt, Artificial Sequence
  Description of Artificial Sequence: Synthetic oligonucleotide
ccccggagacacggcugga

SEQ ID NO: 9979 - RNA, 19 nt, Artificial Sequence
  Description of Artificial Sequence: Synthetic oligonucleotide
cccggagacacggcuggga

SEQ ID NO: 9980 - RNA, 19 nt, Artificial Sequence
  Description of Artificial Sequence: Synthetic oligonucleotide
ccggagacacggcugggca

SEQ ID NO: 9981 - RNA, 19 nt, Artificial Sequence
  Description of Artificial Sequence: Synthetic oligonucleotide
cggagacacggcugggcca

SEQ ID NO: 9982 - RNA, 19 nt, Artificial Sequence
  Description of Artificial Sequence: Synthetic oligonucleotide
ggagacacggcugggccga

SEQ ID NO: 9983 - RNA, 19 nt, Artificial Sequence
  Description of Artificial Sequence: Synthetic oligonucleotide
gagacacggcugggccgga

SEQ ID NO: 9984 - RNA, 19 nt, Artificial Sequence
  Description of Artificial Sequence: Synthetic oligonucleotide
agacacggcugggccggga

SEQ ID NO: 9985 - RNA, 19 nt, Artificial Sequence
  Description of Artificial Sequence: Synthetic oligonucleotide
gacacggcugggccgggga

SEQ ID NO: 9986 - RNA, 19 nt, Artificial Sequence
  Description of Artificial Sequence: Synthetic oligonucleotide
acacggcugggccggggua

SEQ ID NO: 9987 - RNA, 19 nt, Artificial Sequence
  Description of Artificial Sequence: Synthetic oligonucleotide
cacggcugggccgggguga

SEQ ID NO: 9988 - RNA, 19 nt, Artificial Sequence
  Description of Artificial Sequence: Synthetic oligonucleotide
acggcugggccggggugga

SEQ ID NO: 9989 - RNA, 19 nt, Artificial Sequence
  Description of Artificial Sequence: Synthetic oligonucleotide
cggcugggccgggguggaa

SEQ ID NO: 9990 - RNA, 19 nt, Artificial Sequence
  Description of Artificial Sequence: Synthetic oligonucleotide
ggcugggccgggguggaga

SEQ ID NO: 9991 - RNA, 19 nt, Artificial Sequence
  Description of Artificial Sequence: Synthetic oligonucleotide
gcugggccgggguggagca

SEQ ID NO: 9992 - RNA, 19 nt, Artificial Sequence
  Description of Artificial Sequence: Synthetic oligonucleotide
cugggccgggguggagcaa

SEQ ID NO: 9993 - RNA, 19 nt, Artificial Sequence
  Description of Artificial Sequence: Synthetic oligonucleotide
ugggccgggguggagcaga

SEQ ID NO: 9994 - RNA, 19 nt, Artificial Sequence
  Description of Artificial Sequence: Synthetic oligonucleotide
gggccgggguggagcagga

SEQ ID NO: 9995 - RNA, 19 nt, Artificial Sequence
  Description of Artificial Sequence: Synthetic oligonucleotide
ggccgggguggagcaggca

SEQ ID NO: 9996 - RNA, 19 nt, Artificial Sequence
  Description of Artificial Sequence: Synthetic oligonucleotide
gccgggguggagcaggcga

SEQ ID NO: 9997 - RNA, 19 nt, Artificial Sequence
  Description of Artificial Sequence: Synthetic oligonucleotide
ccgggguggagcaggcgaa

SEQ ID NO: 9998 - RNA, 19 nt, Artificial Sequence
  Description of Artificial Sequence: Synthetic oligonucleotide
cgggguggagcaggcgaca

SEQ ID NO: 9999 - RNA, 19 nt, Artificial Sequence
  Description of Artificial Sequence: Synthetic oligonucleotide
gggguggagcaggcgacua

SEQ ID NO: 10000 - RNA, 19 nt, Artificial Sequence
  Description of Artificial Sequence: Synthetic oligonucleotide
ggguggagcaggcgacuua

SEQ ID NO: 10001 - RNA, 19 nt, Artificial Sequence
  Description of Artificial Sequence: Synthetic oligonucleotide
gguggagcaggcgacuuca

SEQ ID NO: 10002 - RNA, 19 nt, Artificial Sequence
  Description of Artificial Sequence: Synthetic oligonucleotide
guggagcaggcgacuucca

SEQ ID NO: 10003 - RNA, 19 nt, Artificial Sequence
  Description of Artificial Sequence: Synthetic oligonucleotide
uggagcaggcgacuuccga

SEQ ID NO: 10004 - RNA, 19 nt, Artificial Sequence
  Description of Artificial Sequence: Synthetic oligonucleotide
ggagcaggcgacuuccgga

SEQ ID NO: 10005 - RNA, 19 nt, Artificial Sequence
  Description of Artificial Sequence: Synthetic oligonucleotide
gagcaggcgacuuccggaa

SEQ ID NO: 10006 - RNA, 19 nt, Artificial Sequence
  Description of Artificial Sequence: Synthetic oligonucleotide
agcaggcgacuuccggaca

SEQ ID NO: 10007 - RNA, 19 nt, Artificial Sequence
  Description of Artificial Sequence: Synthetic oligonucleotide
gcaggcgacuuccggacaa

SEQ ID NO: 10008 - RNA, 19 nt, Artificial Sequence
  Description of Artificial Sequence: Synthetic oligonucleotide
caggcgacuuccggacaca

SEQ ID NO: 10009 - RNA, 19 nt, Artificial Sequence
  Description of Artificial Sequence: Synthetic oligonucleotide
aggcgacuuccggacacaa

SEQ ID NO: 10010 - RNA, 19 nt, Artificial Sequence
  Description of Artificial Sequence: Synthetic oligonucleotide
ggcgacuuccggacacaua

SEQ ID NO: 10011 - RNA, 19 nt, Artificial Sequence
  Description of Artificial Sequence: Synthetic oligonucleotide
gcgacuuccggacacauca

SEQ ID NO: 10012 - RNA, 19 nt, Artificial Sequence
  Description of Artificial Sequence: Synthetic oligonucleotide
cgacuuccggacacaucca

SEQ ID NO: 10013 - RNA, 19 nt, Artificial Sequence
  Description of Artificial Sequence: Synthetic oligonucleotide
gacuuccggacacauccca

SEQ ID NO: 10014 - RNA, 19 nt, Artificial Sequence
  Description of Artificial Sequence: Synthetic oligonucleotide
acuuccggacacaucccua

SEQ ID NO: 10015 - RNA, 19 nt, Artificial Sequence
  Description of Artificial Sequence: Synthetic oligonucleotide
cuuccggacacaucccuua

SEQ ID NO: 10016 - RNA, 19 nt, Artificial Sequence
  Description of Artificial Sequence: Synthetic oligonucleotide
uuccggacacaucccuuca

SEQ ID NO: 10017 - RNA, 19 nt, Artificial Sequence
  Description of Artificial Sequence: Synthetic oligonucleotide
uccggacacaucccuucua

SEQ ID NO: 10018 - RNA, 19 nt, Artificial Sequence
  Description of Artificial Sequence: Synthetic oligonucleotide
ccggacacaucccuucuua

SEQ ID NO: 10019 - RNA, 19 nt, Artificial Sequence
  Description of Artificial Sequence: Synthetic oligonucleotide
cggacacaucccuucuuca

SEQ ID NO: 10020 - RNA, 19 nt, Artificial Sequence
  Description of Artificial Sequence: Synthetic oligonucleotide
ggacacaucccuucuucua

SEQ ID NO: 10021 - RNA, 19 nt, Artificial Sequence
  Description of Artificial Sequence: Synthetic oligonucleotide
gacacaucccuucuucuua

SEQ ID NO: 10022 - RNA, 19 nt, Artificial Sequence
  Description of Artificial Sequence: Synthetic oligonucleotide
acacaucccuucuucuuua

SEQ ID NO: 10023 - RNA, 19 nt, Artificial Sequence
  Description of Artificial Sequence: Synthetic oligonucleotide
cacaucccuucuucuuuga

SEQ ID NO: 10024 - RNA, 19 nt, Artificial Sequence
  Description of Artificial Sequence: Synthetic oligonucleotide
acaucccuucuucuuugga

SEQ ID NO: 10025 - RNA, 19 nt, Artificial Sequence
  Description of Artificial Sequence: Synthetic oligonucleotide
caucccuucuucuuuggca

SEQ ID NO: 10026 - RNA, 19 nt, Artificial Sequence
  Description of Artificial Sequence: Synthetic oligonucleotide
aucccuucuucuuuggcca

SEQ ID NO: 10027 - RNA, 19 nt, Artificial Sequence
  Description of Artificial Sequence: Synthetic oligonucleotide
ucccuucuucuuuggccua

SEQ ID NO: 10028 - RNA, 19 nt, Artificial Sequence
  Description of Artificial Sequence: Synthetic oligonucleotide
cccuucuucuuuggccuca

SEQ ID NO: 10029 - RNA, 19 nt, Artificial Sequence
  Description of Artificial Sequence: Synthetic oligonucleotide
ccuucuucuuuggccucga

SEQ ID NO: 10030 - RNA, 19 nt, Artificial Sequence
  Description of Artificial Sequence: Synthetic oligonucleotide
cuucuucuuuggccucgaa

SEQ ID NO: 10031 - RNA, 19 nt, Artificial Sequence
  Description of Artificial Sequence: Synthetic oligonucleotide
uucuucuuuggccucgaca

SEQ ID NO: 10032 - RNA, 19 nt, Artificial Sequence
  Description of Artificial Sequence: Synthetic oligonucleotide
ucuucuuuggccucgacua

SEQ ID NO: 10033 - RNA, 19 nt, Artificial Sequence
  Description of Artificial Sequence: Synthetic oligonucleotide
cuucuuuggccucgacuga

SEQ ID NO: 10034 - RNA, 19 nt, Artificial Sequence
  Description of Artificial Sequence: Synthetic oligonucleotide
uucuuuggccucgacugga

SEQ ID NO: 10035 - RNA, 19 nt, Artificial Sequence
  Description of Artificial Sequence: Synthetic oligonucleotide
ucuuuggccucgacuggga

SEQ ID NO: 10036 - RNA, 19 nt, Artificial Sequence
  Description of Artificial Sequence: Synthetic oligonucleotide
cuuuggccucgacugggaa

SEQ ID NO: 10037 - RNA, 19 nt, Artificial Sequence
  Description of Artificial Sequence: Synthetic oligonucleotide
uuuggccucgacugggaua

SEQ ID NO: 10038 - RNA, 19 nt, Artificial Sequence
  Description of Artificial Sequence: Synthetic oligonucleotide
uuggccucgacugggauga

SEQ ID NO: 10039 - RNA, 19 nt, Artificial Sequence
  Description of Artificial Sequence: Synthetic oligonucleotide
uggccucgacugggaugga

SEQ ID NO: 10040 - RNA, 19 nt, Artificial Sequence
  Description of Artificial Sequence: Synthetic oligonucleotide
ggccucgacugggauggua

SEQ ID NO: 10041 - RNA, 19 nt, Artificial Sequence
  Description of Artificial Sequence: Synthetic oligonucleotide
gccucgacugggaugguca

SEQ ID NO: 10042 - RNA, 19 nt, Artificial Sequence
  Description of Artificial Sequence: Synthetic oligonucleotide
ccucgacugggauggucua

SEQ ID NO: 10043 - RNA, 19 nt, Artificial Sequence
  Description of Artificial Sequence: Synthetic oligonucleotide
cucgacugggauggucuca

SEQ ID NO: 10044 - RNA, 19 nt, Artificial Sequence
  Description of Artificial Sequence: Synthetic oligonucleotide
ucgacugggauggucucca

SEQ ID NO: 10045 - RNA, 19 nt, Artificial Sequence
  Description of Artificial Sequence: Synthetic oligonucleotide
cgacugggauggucuccga

SEQ ID NO: 10046 - RNA, 19 nt, Artificial Sequence
  Description of Artificial Sequence: Synthetic oligonucleotide
gacugggauggucuccgga

SEQ ID NO: 10047 - RNA, 19 nt, Artificial Sequence
  Description of Artificial Sequence: Synthetic oligonucleotide
acugggauggucuccggga

SEQ ID NO: 10048 - RNA, 19 nt, Artificial Sequence
  Description of Artificial Sequence: Synthetic oligonucleotide
cugggauggucuccgggaa

SEQ ID NO: 10049 - RNA, 19 nt, Artificial Sequence
  Description of Artificial Sequence: Synthetic oligonucleotide
ugggauggucuccgggaca

SEQ ID NO: 10050 - RNA, 19 nt, Artificial Sequence
  Description of Artificial Sequence: Synthetic oligonucleotide
gggauggucuccgggacaa

SEQ ID NO: 10051 - RNA, 19 nt, Artificial Sequence
  Description of Artificial Sequence: Synthetic oligonucleotide
ggauggucuccgggacaga

SEQ ID NO: 10052 - RNA, 19 nt, Artificial Sequence
  Description of Artificial Sequence: Synthetic oligonucleotide
gauggucuccgggacagca

SEQ ID NO: 10053 - RNA, 19 nt, Artificial Sequence
  Description of Artificial Sequence: Synthetic oligonucleotide
auggucuccgggacagcga

SEQ ID NO: 10054 - RNA, 19 nt, Artificial Sequence
  Description of Artificial Sequence: Synthetic oligonucleotide
uggucuccgggacagcgua

SEQ ID NO: 10055 - RNA, 19 nt, Artificial Sequence
  Description of Artificial Sequence: Synthetic oligonucleotide
ggucuccgggacagcguga

SEQ ID NO: 10056 - RNA, 19 nt, Artificial Sequence
  Description of Artificial Sequence: Synthetic oligonucleotide
gucuccgggacagcgugca

SEQ ID NO: 10057 - RNA, 19 nt, Artificial Sequence
  Description of Artificial Sequence: Synthetic oligonucleotide
ucuccgggacagcgugcca

SEQ ID NO: 10058 - RNA, 19 nt, Artificial Sequence
  Description of Artificial Sequence: Synthetic oligonucleotide
cuccgggacagcgugccca

SEQ ID NO: 10059 - RNA, 19 nt, Artificial Sequence
  Description of Artificial Sequence: Synthetic oligonucleotide
uccgggacagcgugcccca

SEQ ID NO: 10060 - RNA, 19 nt, Artificial Sequence
  Description of Artificial Sequence: Synthetic oligonucleotide
ccgggacagcgugccccca

SEQ ID NO: 10061 - RNA, 19 nt, Artificial Sequence
  Description of Artificial Sequence: Synthetic oligonucleotide
cgggacagcgugcccccca

SEQ ID NO: 10062 - RNA, 19 nt, Artificial Sequence
  Description of Artificial Sequence: Synthetic oligonucleotide
gggacagcgugccccccua

SEQ ID NO: 10063 - RNA, 19 nt, Artificial Sequence
  Description of Artificial Sequence: Synthetic oligonucleotide
ggacagcgugccccccuua

SEQ ID NO: 10064 - RNA, 19 nt, Artificial Sequence
  Description of Artificial Sequence: Synthetic oligonucleotide
gacagcgugccccccuuua

SEQ ID NO: 10065 - RNA, 19 nt, Artificial Sequence
  Description of Artificial Sequence: Synthetic oligonucleotide
acagcgugccccccuuuaa

SEQ ID NO: 10066 - RNA, 19 nt, Artificial Sequence
  Description of Artificial Sequence: Synthetic oligonucleotide
cagcgugccccccuuuaca

SEQ ID NO: 10067 - RNA, 19 nt, Artificial Sequence
  Description of Artificial Sequence: Synthetic oligonucleotide
agcgugccccccuuuacaa

SEQ ID NO: 10068 - RNA, 19 nt, Artificial Sequence
  Description of Artificial Sequence: Synthetic oligonucleotide
gcgugccccccuuuacaca

SEQ ID NO: 10069 - RNA, 19 nt, Artificial Sequence
  Description of Artificial Sequence: Synthetic oligonucleotide
cgugccccccuuuacacca

SEQ ID NO: 10070 - RNA, 19 nt, Artificial Sequence
  Description of Artificial Sequence: Synthetic oligonucleotide
gugccccccuuuacaccga

SEQ ID NO: 10071 - RNA, 19 nt, Artificial Sequence
  Description of Artificial Sequence: Synthetic oligonucleotide
ugccccccuuuacaccgga

SEQ ID NO: 10072 - RNA, 19 nt, Artificial Sequence
  Description of Artificial Sequence: Synthetic oligonucleotide
gccccccuuuacaccggaa

SEQ ID NO: 10073 - RNA, 19 nt, Artificial Sequence
  Description of Artificial Sequence: Synthetic oligonucleotide
ccccccuuuacaccggaua

SEQ ID NO: 10074 - RNA, 19 nt, Artificial Sequence
  Description of Artificial Sequence: Synthetic oligonucleotide
cccccuuuacaccggauua

SEQ ID NO: 10075 - RNA, 19 nt, Artificial Sequence
  Description of Artificial Sequence: Synthetic oligonucleotide
ccccuuuacaccggauuua

SEQ ID NO: 10076 - RNA, 19 nt, Artificial Sequence
  Description of Artificial Sequence: Synthetic oligonucleotide
cccuuuacaccggauuuca

SEQ ID NO: 10077 - RNA, 19 nt, Artificial Sequence
  Description of Artificial Sequence: Synthetic oligonucleotide
ccuuuacaccggauuucga

SEQ ID NO: 10078 - RNA, 19 nt, Artificial Sequence
  Description of Artificial Sequence: Synthetic oligonucleotide
cuuuacaccggauuucgaa

SEQ ID NO: 10079 - RNA, 19 nt, Artificial Sequence
  Description of Artificial Sequence: Synthetic oligonucleotide
uuuacaccggauuucgaaa

SEQ ID NO: 10080 - RNA, 19 nt, Artificial Sequence
  Description of Artificial Sequence: Synthetic oligonucleotide
uuacaccggauuucgaaga

SEQ ID NO: 10081 - RNA, 19 nt, Artificial Sequence
  Description of Artificial Sequence: Synthetic oligonucleotide
uacaccggauuucgaagga

SEQ ID NO: 10082 - RNA, 19 nt, Artificial Sequence
  Description of Artificial Sequence: Synthetic oligonucleotide
acaccggauuucgaaggua

SEQ ID NO: 10083 - RNA, 19 nt, Artificial Sequence
  Description of Artificial Sequence: Synthetic oligonucleotide
caccggauuucgaagguga

SEQ ID NO: 10084 - RNA, 19 nt, Artificial Sequence
  Description of Artificial Sequence: Synthetic oligonucleotide
accggauuucgaaggugca

SEQ ID NO: 10085 - RNA, 19 nt, Artificial Sequence
  Description of Artificial Sequence: Synthetic oligonucleotide
ccggauuucgaaggugcca

SEQ ID NO: 10086 - RNA, 19 nt, Artificial Sequence
  Description of Artificial Sequence: Synthetic oligonucleotide
cggauuucgaaggugccaa

SEQ ID NO: 10087 - RNA, 19 nt, Artificial Sequence
  Description of Artificial Sequence: Synthetic oligonucleotide
ggauuucgaaggugccaca

SEQ ID NO: 10088 - RNA, 19 nt, Artificial Sequence
  Description of Artificial Sequence: Synthetic oligonucleotide
gauuucgaaggugccacca

SEQ ID NO: 10089 - RNA, 19 nt, Artificial Sequence
  Description of Artificial Sequence: Synthetic oligonucleotide
auuucgaaggugccaccga

SEQ ID NO: 10090 - RNA, 19 nt, Artificial Sequence
  Description of Artificial Sequence: Synthetic oligonucleotide
uuucgaaggugccaccgaa

SEQ ID NO: 10091 - RNA, 19 nt, Artificial Sequence
  Description of Artificial Sequence: Synthetic oligonucleotide
uucgaaggugccaccgaca

SEQ ID NO: 10092 - RNA, 19 nt, Artificial Sequence
  Description of Artificial Sequence: Synthetic oligonucleotide
ucgaaggugccaccgacaa

SEQ ID NO: 10093 - RNA, 19 nt, Artificial Sequence
  Description of Artificial Sequence: Synthetic oligonucleotide
cgaaggugccaccgacaca

SEQ ID NO: 10094 - RNA, 19 nt, Artificial Sequence
  Description of Artificial Sequence: Synthetic oligonucleotide
gaaggugccaccgacacaa

SEQ ID NO: 10095 - RNA, 19 nt, Artificial Sequence
  Description of Artificial Sequence: Synthetic oligonucleotide
aaggugccaccgacacaua

SEQ ID NO: 10096 - RNA, 19 nt, Artificial Sequence
  Description of Artificial Sequence: Synthetic oligonucleotide
aggugccaccgacacauga

SEQ ID NO: 10097 - RNA, 19 nt, Artificial Sequence
  Description of Artificial Sequence: Synthetic oligonucleotide
ggugccaccgacacaugca

SEQ ID NO: 10098 - RNA, 19 nt, Artificial Sequence
  Description of Artificial Sequence: Synthetic oligonucleotide
gugccaccgacacaugcaa

SEQ ID NO: 10099 - RNA, 19 nt, Artificial Sequence
  Description of Artificial Sequence: Synthetic oligonucleotide
ugccaccgacacaugcaaa

SEQ ID NO: 10100 - RNA, 19 nt, Artificial Sequence
  Description of Artificial Sequence: Synthetic oligonucleotide
gccaccgacacaugcaaca

SEQ ID NO: 10101 - RNA, 19 nt, Artificial Sequence
  Description of Artificial Sequence: Synthetic oligonucleotide
ccaccgacacaugcaacua

SEQ ID NO: 10102 - RNA, 19 nt, Artificial Sequence
  Description of Artificial Sequence: Synthetic oligonucleotide
caccgacacaugcaacuua

SEQ ID NO: 10103 - RNA, 19 nt, Artificial Sequence
  Description of Artificial Sequence: Synthetic oligonucleotide
accgacacaugcaacuuca

SEQ ID NO: 10104 - RNA, 19 nt, Artificial Sequence
  Description of Artificial Sequence: Synthetic oligonucleotide
ccgacacaugcaacuucga

SEQ ID NO: 10105 - RNA, 19 nt, Artificial Sequence
  Description of Artificial Sequence: Synthetic oligonucleotide
cgacacaugcaacuucgaa

SEQ ID NO: 10106 - RNA, 19 nt, Artificial Sequence
  Description of Artificial Sequence: Synthetic oligonucleotide
gacacaugcaacuucgaca

SEQ ID NO: 10107 - RNA, 19 nt, Artificial Sequence
  Description of Artificial Sequence: Synthetic oligonucleotide
acacaugcaacuucgacua

SEQ ID NO: 10108 - RNA, 19 nt, Artificial Sequence
  Description of Artificial Sequence: Synthetic oligonucleotide
cacaugcaacuucgacuua

SEQ ID NO: 10109 - RNA, 19 nt, Artificial Sequence
  Description of Artificial Sequence: Synthetic oligonucleotide
acaugcaacuucgacuuga

SEQ ID NO: 10110 - RNA, 19 nt, Artificial Sequence
  Description of Artificial Sequence: Synthetic oligonucleotide
caugcaacuucgacuugga

SEQ ID NO: 10111 - RNA, 19 nt, Artificial Sequence
  Description of Artificial Sequence: Synthetic oligonucleotide
augcaacuucgacuuggua

SEQ ID NO: 10112 - RNA, 19 nt, Artificial Sequence
  Description of Artificial Sequence: Synthetic oligonucleotide
ugcaacuucgacuugguga

SEQ ID NO: 10113 - RNA, 19 nt, Artificial Sequence
  Description of Artificial Sequence: Synthetic oligonucleotide
gcaacuucgacuuggugga

SEQ ID NO: 10114 - RNA, 19 nt, Artificial Sequence
  Description of Artificial Sequence: Synthetic oligonucleotide
caacuucgacuugguggaa

SEQ ID NO: 10115 - RNA, 19 nt, Artificial Sequence
  Description of Artificial Sequence: Synthetic oligonucleotide
aacuucgacuugguggaga

SEQ ID NO: 10116 - RNA, 19 nt, Artificial Sequence
  Description of Artificial Sequence: Synthetic oligonucleotide
acuucgacuugguggagga

SEQ ID NO: 10117 - RNA, 19 nt, Artificial Sequence
  Description of Artificial Sequence: Synthetic oligonucleotide
cuucgacuugguggaggaa

SEQ ID NO: 10118 - RNA, 19 nt, Artificial Sequence
  Description of Artificial Sequence: Synthetic oligonucleotide
uucgacuugguggaggaca

SEQ ID NO: 10119 - RNA, 19 nt, Artificial Sequence
  Description of Artificial Sequence: Synthetic oligonucleotide
ucgacuugguggaggacga

SEQ ID NO: 10120 - RNA, 19 nt, Artificial Sequence
  Description of Artificial Sequence: Synthetic oligonucleotide
cgacuugguggaggacgga

SEQ ID NO: 10121 - RNA, 19 nt, Artificial Sequence
  Description of Artificial Sequence: Synthetic oligonucleotide
gacuugguggaggacggga

SEQ ID NO: 10122 - RNA, 19 nt, Artificial Sequence
  Description of Artificial Sequence: Synthetic oligonucleotide
acuugguggaggacgggca

SEQ ID NO: 10123 - RNA, 19 nt, Artificial Sequence
  Description of Artificial Sequence: Synthetic oligonucleotide
cuugguggaggacgggcua

SEQ ID NO: 10124 - RNA, 19 nt, Artificial Sequence
  Description of Artificial Sequence: Synthetic oligonucleotide
uugguggaggacgggcuca

SEQ ID NO: 10125 - RNA, 19 nt, Artificial Sequence
  Description of Artificial Sequence: Synthetic oligonucleotide
ugguggaggacgggcucaa

SEQ ID NO: 10126 - RNA, 19 nt, Artificial Sequence
  Description of Artificial Sequence: Synthetic oligonucleotide
gguggaggacgggcucaca

SEQ ID NO: 10127 - RNA, 19 nt, Artificial Sequence
  Description of Artificial Sequence: Synthetic oligonucleotide
guggaggacgggcucacua

SEQ ID NO: 10128 - RNA, 19 nt, Artificial Sequence
  Description of Artificial Sequence: Synthetic oligonucleotide
uggaggacgggcucacuga

SEQ ID NO: 10129 - RNA, 19 nt, Artificial Sequence
  Description of Artificial Sequence: Synthetic oligonucleotide
ggaggacgggcucacugca

SEQ ID NO: 10130 - RNA, 19 nt, Artificial Sequence
  Description of Artificial Sequence: Synthetic oligonucleotide
gaggacgggcucacugcca

SEQ ID NO: 10131 - RNA, 19 nt, Artificial Sequence
  Description of Artificial Sequence: Synthetic oligonucleotide
aggacgggcucacugccaa

SEQ ID NO: 10132 - RNA, 19 nt, Artificial Sequence
  Description of Artificial Sequence: Synthetic oligonucleotide
ggacgggcucacugccaua

SEQ ID NO: 10133 - RNA, 19 nt, Artificial Sequence
  Description of Artificial Sequence: Synthetic oligonucleotide
gacgggcucacugccauga

SEQ ID NO: 10134 - RNA, 19 nt, Artificial Sequence
  Description of Artificial Sequence: Synthetic oligonucleotide
acgggcucacugccaugga

SEQ ID NO: 10135 - RNA, 19 nt, Artificial Sequence
  Description of Artificial Sequence: Synthetic oligonucleotide
cgggcucacugccauggaa

SEQ ID NO: 10136 - RNA, 19 nt, Artificial Sequence
  Description of Artificial Sequence: Synthetic oligonucleotide
gggcucacugccauggaga

SEQ ID NO: 10137 - RNA, 19 nt, Artificial Sequence
  Description of Artificial Sequence: Synthetic oligonucleotide
ggcucacugccauggagaa

SEQ ID NO: 10138 - RNA, 19 nt, Artificial Sequence
  Description of Artificial Sequence: Synthetic oligonucleotide
gcucacugccauggagaca

SEQ ID NO: 10139 - RNA, 19 nt, Artificial Sequence
  Description of Artificial Sequence: Synthetic oligonucleotide
cucacugccauggagacaa

SEQ ID NO: 10140 - RNA, 19 nt, Artificial Sequence
  Description of Artificial Sequence: Synthetic oligonucleotide
ucacugccauggagacaca

SEQ ID NO: 10141 - RNA, 19 nt, Artificial Sequence
  Description of Artificial Sequence: Synthetic oligonucleotide
cacugccauggagacacua

SEQ ID NO: 10142 - RNA, 19 nt, Artificial Sequence
  Description of Artificial Sequence: Synthetic oligonucleotide
acugccauggagacacuga

SEQ ID NO: 10143 - RNA, 19 nt, Artificial Sequence
  Description of Artificial Sequence: Synthetic oligonucleotide
cugccauggagacacugua

SEQ ID NO: 10144 - RNA, 19 nt, Artificial Sequence
  Description of Artificial Sequence: Synthetic oligonucleotide
ugccauggagacacuguca

SEQ ID NO: 10145 - RNA, 19 nt, Artificial Sequence
  Description of Artificial Sequence: Synthetic oligonucleotide
gccauggagacacugucga

SEQ ID NO: 10146 - RNA, 19 nt, Artificial Sequence
  Description of Artificial Sequence: Synthetic oligonucleotide
ccauggagacacugucgga

SEQ ID NO: 10147 - RNA, 19 nt, Artificial Sequence
  Description of Artificial Sequence: Synthetic oligonucleotide
cauggagacacugucggaa

SEQ ID NO: 10148 - RNA, 19 nt, Artificial Sequence
  Description of Artificial Sequence: Synthetic oligonucleotide
auggagacacugucggaca

SEQ ID NO: 10149 - RNA, 19 nt, Artificial Sequence
  Description of Artificial Sequence: Synthetic oligonucleotide
uggagacacugucggacaa

SEQ ID NO: 10150 - RNA, 19 nt, Artificial Sequence
  Description of Artificial Sequence: Synthetic oligonucleotide
ggagacacugucggacaua

SEQ ID NO: 10151 - RNA, 19 nt, Artificial Sequence
  Description of Artificial Sequence: Synthetic oligonucleotide
gagacacugucggacauua

SEQ ID NO: 10152 - RNA, 19 nt, Artificial Sequence
  Description of Artificial Sequence: Synthetic oligonucleotide
agacacugucggacauuca

SEQ ID NO: 10153 - RNA, 19 nt, Artificial Sequence
  Description of Artificial Sequence: Synthetic oligonucleotide
gacacugucggacauucga

SEQ ID NO: 10154 - RNA, 19 nt, Artificial Sequence
  Description of Artificial Sequence: Synthetic oligonucleotide
acacugucggacauucgga

SEQ ID NO: 10155 - RNA, 19 nt, Artificial Sequence
  Description of Artificial Sequence: Synthetic oligonucleotide
cacugucggacauucggga

SEQ ID NO: 10156 - RNA, 19 nt, Artificial Sequence
  Description of Artificial Sequence: Synthetic oligonucleotide
acugucggacauucgggaa

SEQ ID NO: 10157 - RNA, 19 nt, Artificial Sequence
  Description of Artificial Sequence: Synthetic oligonucleotide
cugucggacauucgggaaa

SEQ ID NO: 10158 - RNA, 19 nt, Artificial Sequence
  Description of Artificial Sequence: Synthetic oligonucleotide
ugucggacauucgggaaga

SEQ ID NO: 10159 - RNA, 19 nt, Artificial Sequence
  Description of Artificial Sequence: Synthetic oligonucleotide
gucggacauucgggaagga

SEQ ID NO: 10160 - RNA, 19 nt, Artificial Sequence
  Description of Artificial Sequence: Synthetic oligonucleotide
ucggacauucgggaaggua

SEQ ID NO: 10161 - RNA, 19 nt, Artificial Sequence
  Description of Artificial Sequence: Synthetic oligonucleotide
cggacauucgggaagguga

SEQ ID NO: 10162 - RNA, 19 nt, Artificial Sequence
  Description of Artificial Sequence: Synthetic oligonucleotide
ggacauucgggaaggugca

SEQ ID NO: 10163 - RNA, 19 nt, Artificial Sequence
  Description of Artificial Sequence: Synthetic oligonucleotide
gacauucgggaaggugcga

SEQ ID NO: 10164 - RNA, 19 nt, Artificial Sequence
  Description of Artificial Sequence: Synthetic oligonucleotide
acauucgggaaggugcgca

SEQ ID NO: 10165 - RNA, 19 nt, Artificial Sequence
  Description of Artificial Sequence: Synthetic oligonucleotide
cauucgggaaggugcgcca

SEQ ID NO: 10166 - RNA, 19 nt, Artificial Sequence
  Description of Artificial Sequence: Synthetic oligonucleotide
auucgggaaggugcgccga

SEQ ID NO: 10167 - RNA, 19 nt, Artificial Sequence
  Description of Artificial Sequence: Synthetic oligonucleotide
uucgggaaggugcgccgca

SEQ ID NO: 10168 - RNA, 19 nt, Artificial Sequence
  Description of Artificial Sequence: Synthetic oligonucleotide
ucgggaaggugcgccgcua

SEQ ID NO: 10169 - RNA, 19 nt, Artificial Sequence
  Description of Artificial Sequence: Synthetic oligonucleotide
cgggaaggugcgccgcuaa

SEQ ID NO: 10170 - RNA, 19 nt, Artificial Sequence
  Description of Artificial Sequence: Synthetic oligonucleotide
gggaaggugcgccgcuaga

SEQ ID NO: 10171 - RNA, 19 nt, Artificial Sequence
  Description of Artificial Sequence: Synthetic oligonucleotide
ggaaggugcgccgcuagga

SEQ ID NO: 10172 - RNA, 19 nt, Artificial Sequence
  Description of Artificial Sequence: Synthetic oligonucleotide
gaaggugcgccgcuaggga

SEQ ID NO: 10173 - RNA, 19 nt, Artificial Sequence
  Description of Artificial Sequence: Synthetic oligonucleotide
aaggugcgccgcuagggga

SEQ ID NO: 10174 - RNA, 19 nt, Artificial Sequence
  Description of Artificial Sequence: Synthetic oligonucleotide
aggugcgccgcuaggggua

SEQ ID NO: 10175 - RNA, 19 nt, Artificial Sequence
  Description of Artificial Sequence: Synthetic oligonucleotide
ggugcgccgcuagggguca

SEQ ID NO: 10176 - RNA, 19 nt, Artificial Sequence
  Description of Artificial Sequence: Synthetic oligonucleotide
gugcgccgcuaggggucca

SEQ ID NO: 10177 - RNA, 19 nt, Artificial Sequence
  Description of Artificial Sequence: Synthetic oligonucleotide
ugcgccgcuagggguccaa

SEQ ID NO: 10178 - RNA, 19 nt, Artificial Sequence
  Description of Artificial Sequence: Synthetic oligonucleotide
gcgccgcuagggguccaca

SEQ ID NO: 10179 - RNA, 19 nt, Artificial Sequence
  Description of Artificial Sequence: Synthetic oligonucleotide
cgccgcuagggguccacca

SEQ ID NO: 10180 - RNA, 19 nt, Artificial Sequence
  Description of Artificial Sequence: Synthetic oligonucleotide
gccgcuagggguccaccua

SEQ ID NO: 10181 - RNA, 19 nt, Artificial Sequence
  Description of Artificial Sequence: Synthetic oligonucleotide
ccgcuagggguccaccuga

SEQ ID NO: 10182 - RNA, 19 nt, Artificial Sequence
  Description of Artificial Sequence: Synthetic oligonucleotide
cgcuagggguccaccugca

SEQ ID NO: 10183 - RNA, 19 nt, Artificial Sequence
  Description of Artificial Sequence: Synthetic oligonucleotide
gcuagggguccaccugcca

SEQ ID NO: 10184 - RNA, 19 nt, Artificial Sequence
  Description of Artificial Sequence: Synthetic oligonucleotide
cuagggguccaccugccua

SEQ ID NO: 10185 - RNA, 19 nt, Artificial Sequence
  Description of Artificial Sequence: Synthetic oligonucleotide
uagggguccaccugccuua

SEQ ID NO: 10186 - RNA, 19 nt, Artificial Sequence
  Description of Artificial Sequence: Synthetic oligonucleotide
agggguccaccugccuuua

SEQ ID NO: 10187 - RNA, 19 nt, Artificial Sequence
  Description of Artificial Sequence: Synthetic oligonucleotide
gggguccaccugccuuuua

SEQ ID NO: 10188 - RNA, 19 nt, Artificial Sequence
  Description of Artificial Sequence: Synthetic oligonucleotide
ggguccaccugccuuuuga

SEQ ID NO: 10189 - RNA, 19 nt, Artificial Sequence
  Description of Artificial Sequence: Synthetic oligonucleotide
gguccaccugccuuuugua

SEQ ID NO: 10190 - RNA, 19 nt, Artificial Sequence
  Description of Artificial Sequence: Synthetic oligonucleotide
guccaccugccuuuuguga

SEQ ID NO: 10191 - RNA, 19 nt, Artificial Sequence
  Description of Artificial Sequence: Synthetic oligonucleotide
uccaccugccuuuugugga

SEQ ID NO: 10192 - RNA, 19 nt, Artificial Sequence
  Description of Artificial Sequence: Synthetic oligonucleotide
ccaccugccuuuuguggga

SEQ ID NO: 10193 - RNA, 19 nt, Artificial Sequence
  Description of Artificial Sequence: Synthetic oligonucleotide
caccugccuuuugugggca

SEQ ID NO: 10194 - RNA, 19 nt, Artificial Sequence
  Description of Artificial Sequence: Synthetic oligonucleotide
accugccuuuugugggcua

SEQ ID NO: 10195 - RNA, 19 nt, Artificial Sequence
  Description of Artificial Sequence: Synthetic oligonucleotide
ccugccuuuugugggcuaa

SEQ ID NO: 10196 - RNA, 19 nt, Artificial Sequence
  Description of Artificial Sequence: Synthetic oligonucleotide
cugccuuuugugggcuaca

SEQ ID NO: 10197 - RNA, 19 nt, Artificial Sequence
  Description of Artificial Sequence: Synthetic oligonucleotide
ugccuuuugugggcuacua

SEQ ID NO: 10198 - RNA, 19 nt, Artificial Sequence
  Description of Artificial Sequence: Synthetic oligonucleotide
gccuuuugugggcuacuca

SEQ ID NO: 10199 - RNA, 19 nt, Artificial Sequence
  Description of Artificial Sequence: Synthetic oligonucleotide
ccuuuugugggcuacucca

SEQ ID NO: 10200 - RNA, 19 nt, Artificial Sequence
  Description of Artificial Sequence: Synthetic oligonucleotide
cuuuugugggcuacuccua

SEQ ID NO: 10201 - RNA, 19 nt, Artificial Sequence
  Description of Artificial Sequence: Synthetic oligonucleotide
uuuugugggcuacuccuaa

SEQ ID NO: 10202 - RNA, 19 nt, Artificial Sequence
  Description of Artificial Sequence: Synthetic oligonucleotide
uuugugggcuacuccuaca

SEQ ID NO: 10203 - RNA, 19 nt, Artificial Sequence
  Description of Artificial Sequence: Synthetic oligonucleotide
uugugggcuacuccuacua

SEQ ID NO: 10204 - RNA, 19 nt, Artificial Sequence
  Description of Artificial Sequence: Synthetic oligonucleotide
ugugggcuacuccuacuca

SEQ ID NO: 10205 - RNA, 19 nt, Artificial Sequence
  Description of Artificial Sequence: Synthetic oligonucleotide
gugggcuacuccuacucca

SEQ ID NO: 10206 - RNA, 19 nt, Artificial Sequence
  Description of Artificial Sequence: Synthetic oligonucleotide
ugggcuacuccuacuccua

SEQ ID NO: 10207 - RNA, 19 nt, Artificial Sequence
  Description of Artificial Sequence: Synthetic oligonucleotide
gggcuacuccuacuccuga

SEQ ID NO: 10208 - RNA, 19 nt, Artificial Sequence
  Description of Artificial Sequence: Synthetic oligonucleotide
ggcuacuccuacuccugca

SEQ ID NO: 10209 - RNA, 19 nt, Artificial Sequence
  Description of Artificial Sequence: Synthetic oligonucleotide
gcuacuccuacuccugcaa

SEQ ID NO: 10210 - RNA, 19 nt, Artificial Sequence
  Description of Artificial Sequence: Synthetic oligonucleotide
cuacuccuacuccugcaua

SEQ ID NO: 10211 - RNA, 19 nt, Artificial Sequence
  Description of Artificial Sequence: Synthetic oligonucleotide
uacuccuacuccugcauga

SEQ ID NO: 10212 - RNA, 19 nt, Artificial Sequence
  Description of Artificial Sequence: Synthetic oligonucleotide
acuccuacuccugcaugga

SEQ ID NO: 10213 - RNA, 19 nt, Artificial Sequence
  Description of Artificial Sequence: Synthetic oligonucleotide
cuccuacuccugcauggca

SEQ ID NO: 10214 - RNA, 19 nt, Artificial Sequence
  Description of Artificial Sequence: Synthetic oligonucleotide
uccuacuccugcauggcca

SEQ ID NO: 10215 - RNA, 19 nt, Artificial Sequence
  Description of Artificial Sequence: Synthetic oligonucleotide
ccuacuccugcauggccca

SEQ ID NO: 10216 - RNA, 19 nt, Artificial Sequence
  Description of Artificial Sequence: Synthetic oligonucleotide
cuacuccugcauggcccua

SEQ ID NO: 10217 - RNA, 19 nt, Artificial Sequence
  Description of Artificial Sequence: Synthetic oligonucleotide
uacuccugcauggcccuca

SEQ ID NO: 10218 - RNA, 19 nt, Artificial Sequence
  Description of Artificial Sequence: Synthetic oligonucleotide
acuccugcauggcccucaa

SEQ ID NO: 10219 - RNA, 19 nt, Artificial Sequence
  Description of Artificial Sequence: Synthetic oligonucleotide
cuccugcauggcccucaga

SEQ ID NO: 10220 - RNA, 19 nt, Artificial Sequence
  Description of Artificial Sequence: Synthetic oligonucleotide
uccugcauggcccucagga

SEQ ID NO: 10221 - RNA, 19 nt, Artificial Sequence
  Description of Artificial Sequence: Synthetic oligonucleotide
ccugcauggcccucaggga

SEQ ID NO: 10222 - RNA, 19 nt, Artificial Sequence
  Description of Artificial Sequence: Synthetic oligonucleotide
cugcauggcccucagggaa

SEQ ID NO: 10223 - RNA, 19 nt, Artificial Sequence
  Description of Artificial Sequence: Synthetic oligonucleotide
ugcauggcccucagggaca

SEQ ID NO: 10224 - RNA, 19 nt, Artificial Sequence
  Description of Artificial Sequence: Synthetic oligonucleotide
gcauggcccucagggacaa

SEQ ID NO: 10225 - RNA, 19 nt, Artificial Sequence
  Description of Artificial Sequence: Synthetic oligonucleotide
cauggcccucagggacaga

SEQ ID NO: 10226 - RNA, 19 nt, Artificial Sequence
  Description of Artificial Sequence: Synthetic oligonucleotide
auggcccucagggacagua

SEQ ID NO: 10227 - RNA, 19 nt, Artificial Sequence
  Description of Artificial Sequence: Synthetic oligonucleotide
uggcccucagggacaguga

SEQ ID NO: 10228 - RNA, 19 nt, Artificial Sequence
  Description of Artificial Sequence: Synthetic oligonucleotide
ggcccucagggacagugaa

SEQ ID NO: 10229 - RNA, 19 nt, Artificial Sequence
  Description of Artificial Sequence: Synthetic oligonucleotide
gcccucagggacagugaga

SEQ ID NO: 10230 - RNA, 19 nt, Artificial Sequence
  Description of Artificial Sequence: Synthetic oligonucleotide
cccucagggacagugagga

SEQ ID NO: 10231 - RNA, 19 nt, Artificial Sequence
  Description of Artificial Sequence: Synthetic oligonucleotide
ccucagggacagugaggua

SEQ ID NO: 10232 - RNA, 19 nt, Artificial Sequence
  Description of Artificial Sequence: Synthetic oligonucleotide
cucagggacagugagguca

SEQ ID NO: 10233 - RNA, 19 nt, Artificial Sequence
  Description of Artificial Sequence: Synthetic oligonucleotide
ucagggacagugaggucca

SEQ ID NO: 10234 - RNA, 19 nt, Artificial Sequence
  Description of Artificial Sequence: Synthetic oligonucleotide
cagggacagugagguccca

SEQ ID NO: 10235 - RNA, 19 nt, Artificial Sequence
  Description of Artificial Sequence: Synthetic oligonucleotide
agggacagugaggucccaa

SEQ ID NO: 10236 - RNA, 19 nt, Artificial Sequence
  Description of Artificial Sequence: Synthetic oligonucleotide
gggacagugaggucccaga

SEQ ID NO: 10237 - RNA, 19 nt, Artificial Sequence
  Description of Artificial Sequence: Synthetic oligonucleotide
ggacagugaggucccagga

SEQ ID NO: 10238 - RNA, 19 nt, Artificial Sequence
  Description of Artificial Sequence: Synthetic oligonucleotide
gacagugaggucccaggca

SEQ ID NO: 10239 - RNA, 19 nt, Artificial Sequence
  Description of Artificial Sequence: Synthetic oligonucleotide
acagugaggucccaggcca

SEQ ID NO: 10240 - RNA, 19 nt, Artificial Sequence
  Description of Artificial Sequence: Synthetic oligonucleotide
cagugaggucccaggccca

SEQ ID NO: 10241 - RNA, 19 nt, Artificial Sequence
  Description of Artificial Sequence: Synthetic oligonucleotide
agugaggucccaggcccca

SEQ ID NO: 10242 - RNA, 19 nt, Artificial Sequence
  Description of Artificial Sequence: Synthetic oligonucleotide
gugaggucccaggccccaa

SEQ ID NO: 10243 - RNA, 19 nt, Artificial Sequence
  Description of Artificial Sequence: Synthetic oligonucleotide
ugaggucccaggccccaca

SEQ ID NO: 10244 - RNA, 19 nt, Artificial Sequence
  Description of Artificial Sequence: Synthetic oligonucleotide
gaggucccaggccccacaa

SEQ ID NO: 10245 - RNA, 19 nt, Artificial Sequence
  Description of Artificial Sequence: Synthetic oligonucleotide
aggucccaggccccacaca

SEQ ID NO: 10246 - RNA, 19 nt, Artificial Sequence
  Description of Artificial Sequence: Synthetic oligonucleotide
ggucccaggccccacacca

SEQ ID NO: 10247 - RNA, 19 nt, Artificial Sequence
  Description of Artificial Sequence: Synthetic oligonucleotide
gucccaggccccacaccca

SEQ ID NO: 10248 - RNA, 19 nt, Artificial Sequence
  Description of Artificial Sequence: Synthetic oligonucleotide
ucccaggccccacacccaa

SEQ ID NO: 10249 - RNA, 19 nt, Artificial Sequence
  Description of Artificial Sequence: Synthetic oligonucleotide
cccaggccccacacccaua

SEQ ID NO: 10250 - RNA, 19 nt, Artificial Sequence
  Description of Artificial Sequence: Synthetic oligonucleotide
ccaggccccacacccauga

SEQ ID NO: 10251 - RNA, 19 nt, Artificial Sequence
  Description of Artificial Sequence: Synthetic oligonucleotide
caggccccacacccaugga

SEQ ID NO: 10252 - RNA, 19 nt, Artificial Sequence
  Description of Artificial Sequence: Synthetic oligonucleotide
aggccccacacccauggaa

SEQ ID NO: 10253 - RNA, 19 nt, Artificial Sequence
  Description of Artificial Sequence: Synthetic oligonucleotide
ggccccacacccauggaaa

SEQ ID NO: 10254 - RNA, 19 nt, Artificial Sequence
  Description of Artificial Sequence: Synthetic oligonucleotide
gccccacacccauggaaca

SEQ ID NO: 10255 - RNA, 19 nt, Artificial Sequence
  Description of Artificial Sequence: Synthetic oligonucleotide
ccccacacccauggaacua

SEQ ID NO: 10256 - RNA, 19 nt, Artificial Sequence
  Description of Artificial Sequence: Synthetic oligonucleotide
cccacacccauggaacuga

SEQ ID NO: 10257 - RNA, 19 nt, Artificial Sequence
  Description of Artificial Sequence: Synthetic oligonucleotide
ccacacccauggaacugga

SEQ ID NO: 10258 - RNA, 19 nt, Artificial Sequence
  Description of Artificial Sequence: Synthetic oligonucleotide
cacacccauggaacuggaa

SEQ ID NO: 10259 - RNA, 19 nt, Artificial Sequence
  Description of Artificial Sequence: Synthetic oligonucleotide
acacccauggaacuggaga

SEQ ID NO: 10260 - RNA, 19 nt, Artificial Sequence
  Description of Artificial Sequence: Synthetic oligonucleotide
cacccauggaacuggagga

SEQ ID NO: 10261 - RNA, 19 nt, Artificial Sequence
  Description of Artificial Sequence: Synthetic oligonucleotide
acccauggaacuggaggca

SEQ ID NO: 10262 - RNA, 19 nt, Artificial Sequence
  Description of Artificial Sequence: Synthetic oligonucleotide
cccauggaacuggaggcca

SEQ ID NO: 10263 - RNA, 19 nt, Artificial Sequence
  Description of Artificial Sequence: Synthetic oligonucleotide
ccauggaacuggaggccga

SEQ ID NO: 10264 - RNA, 19 nt, Artificial Sequence
  Description of Artificial Sequence: Synthetic oligonucleotide
cauggaacuggaggccgaa

SEQ ID NO: 10265 - RNA, 19 nt, Artificial Sequence
  Description of Artificial Sequence: Synthetic oligonucleotide
auggaacuggaggccgaga

SEQ ID NO: 10266 - RNA, 19 nt, Artificial Sequence
  Description of Artificial Sequence: Synthetic oligonucleotide
uggaacuggaggccgagca

SEQ ID NO: 10267 - RNA, 19 nt, Artificial Sequence
  Description of Artificial Sequence: Synthetic oligonucleotide
ggaacuggaggccgagcaa

SEQ ID NO: 10268 - RNA, 19 nt, Artificial Sequence
  Description of Artificial Sequence: Synthetic oligonucleotide
gaacuggaggccgagcaga

SEQ ID NO: 10269 - RNA, 19 nt, Artificial Sequence
  Description of Artificial Sequence: Synthetic oligonucleotide
aacuggaggccgagcagca

SEQ ID NO: 10270 - RNA, 19 nt, Artificial Sequence
  Description of Artificial Sequence: Synthetic oligonucleotide
acuggaggccgagcagcua

SEQ ID NO: 10271 - RNA, 19 nt, Artificial Sequence
  Description of Artificial Sequence: Synthetic oligonucleotide
cuggaggccgagcagcuga

SEQ ID NO: 10272 - RNA, 19 nt, Artificial Sequence
  Description of Artificial Sequence: Synthetic oligonucleotide
uggaggccgagcagcugca

SEQ ID NO: 10273 - RNA, 19 nt, Artificial Sequence
  Description of Artificial Sequence: Synthetic oligonucleotide
ggaggccgagcagcugcua

SEQ ID NO: 10274 - RNA, 19 nt, Artificial Sequence
  Description of Artificial Sequence: Synthetic oligonucleotide
gaggccgagcagcugcuua

SEQ ID NO: 10275 - RNA, 19 nt, Artificial Sequence
  Description of Artificial Sequence: Synthetic oligonucleotide
aggccgagcagcugcuuga

SEQ ID NO: 10276 - RNA, 19 nt, Artificial Sequence
  Description of Artificial Sequence: Synthetic oligonucleotide
ggccgagcagcugcuugaa

SEQ ID NO: 10277 - RNA, 19 nt, Artificial Sequence
  Description of Artificial Sequence: Synthetic oligonucleotide
gccgagcagcugcuugaga

SEQ ID NO: 10278 - RNA, 19 nt, Artificial Sequence
  Description of Artificial Sequence: Synthetic oligonucleotide
ccgagcagcugcuugagca

SEQ ID NO: 10279 - RNA, 19 nt, Artificial Sequence
  Description of Artificial Sequence: Synthetic oligonucleotide
cgagcagcugcuugagcca

SEQ ID NO: 10280 - RNA, 19 nt, Artificial Sequence
  Description of Artificial Sequence: Synthetic oligonucleotide
gagcagcugcuugagccaa

SEQ ID NO: 10281 - RNA, 19 nt, Artificial Sequence
  Description of Artificial Sequence: Synthetic oligonucleotide
agcagcugcuugagccaca

SEQ ID NO: 10282 - RNA, 19 nt, Artificial Sequence
  Description of Artificial Sequence: Synthetic oligonucleotide
gcagcugcuugagccacaa

SEQ ID NO: 10283 - RNA, 19 nt, Artificial Sequence
  Description of Artificial Sequence: Synthetic oligonucleotide
cagcugcuugagccacaca

SEQ ID NO: 10284 - RNA, 19 nt, Artificial Sequence
  Description of Artificial Sequence: Synthetic oligonucleotide
agcugcuugagccacacga

SEQ ID NO: 10285 - RNA, 19 nt, Artificial Sequence
  Description of Artificial Sequence: Synthetic oligonucleotide
gcugcuugagccacacgua

SEQ ID NO: 10286 - RNA, 19 nt, Artificial Sequence
  Description of Artificial Sequence: Synthetic oligonucleotide
cugcuugagccacacguga

SEQ ID NO: 10287 - RNA, 19 nt, Artificial Sequence
  Description of Artificial Sequence: Synthetic oligonucleotide
ugcuugagccacacgugca

SEQ ID NO: 10288 - RNA, 19 nt, Artificial Sequence
  Description of Artificial Sequence: Synthetic oligonucleotide
gcuugagccacacgugcaa

SEQ ID NO: 10289 - RNA, 19 nt, Artificial Sequence
  Description of Artificial Sequence: Synthetic oligonucleotide
cuugagccacacgugcaaa

SEQ ID NO: 10290 - RNA, 19 nt, Artificial Sequence
  Description of Artificial Sequence: Synthetic oligonucleotide
uugagccacacgugcaaga

SEQ ID NO: 10291 - RNA, 19 nt, Artificial Sequence
  Description of Artificial Sequence: Synthetic oligonucleotide
ugagccacacgugcaagca

SEQ ID NO: 10292 - RNA, 19 nt, Artificial Sequence
  Description of Artificial Sequence: Synthetic oligonucleotide
gagccacacgugcaagcga

SEQ ID NO: 10293 - RNA, 19 nt, Artificial Sequence
  Description of Artificial Sequence: Synthetic oligonucleotide
agccacacgugcaagcgca

SEQ ID NO: 10294 - RNA, 19 nt, Artificial Sequence
  Description of Artificial Sequence: Synthetic oligonucleotide
gccacacgugcaagcgcca

SEQ ID NO: 10295 - RNA, 19 nt, Artificial Sequence
  Description of Artificial Sequence: Synthetic oligonucleotide
ccacacgugcaagcgccca

SEQ ID NO: 10296 - RNA, 19 nt, Artificial Sequence
  Description of Artificial Sequence: Synthetic oligonucleotide
cacacgugcaagcgcccaa

SEQ ID NO: 10297 - RNA, 19 nt, Artificial Sequence
  Description of Artificial Sequence: Synthetic oligonucleotide
acacgugcaagcgcccaga

SEQ ID NO: 10298 - RNA, 19 nt, Artificial Sequence
  Description of Artificial Sequence: Synthetic oligonucleotide
cacgugcaagcgcccagca

SEQ ID NO: 10299 - RNA, 19 nt, Artificial Sequence
  Description of Artificial Sequence: Synthetic oligonucleotide
acgugcaagcgcccagcca

SEQ ID NO: 10300 - RNA, 19 nt, Artificial Sequence
  Description of Artificial Sequence: Synthetic oligonucleotide
cgugcaagcgcccagccua

SEQ ID NO: 10301 - RNA, 19 nt, Artificial Sequence
  Description of Artificial Sequence: Synthetic oligonucleotide
gugcaagcgcccagccuga

SEQ ID NO: 10302 - RNA, 19 nt, Artificial Sequence
  Description of Artificial Sequence: Synthetic oligonucleotide
ugcaagcgcccagccugga

SEQ ID NO: 10303 - RNA, 19 nt, Artificial Sequence
  Description of Artificial Sequence: Synthetic oligonucleotide
gcaagcgcccagccuggaa

SEQ ID NO: 10304 - RNA, 19 nt, Artificial Sequence
  Description of Artificial Sequence: Synthetic oligonucleotide
caagcgcccagccuggaga

SEQ ID NO: 10305 - RNA, 19 nt, Artificial Sequence
  Description of Artificial Sequence: Synthetic oligonucleotide
aagcgcccagccuggagca

SEQ ID NO: 10306 - RNA, 19 nt, Artificial Sequence
  Description of Artificial Sequence: Synthetic oligonucleotide
agcgcccagccuggagcca

SEQ ID NO: 10307 - RNA, 19 nt, Artificial Sequence
  Description of Artificial Sequence: Synthetic oligonucleotide
gcgcccagccuggagccca

SEQ ID NO: 10308 - RNA, 19 nt, Artificial Sequence
  Description of Artificial Sequence: Synthetic oligonucleotide
cgcccagccuggagcccua

SEQ ID NO: 10309 - RNA, 19 nt, Artificial Sequence
  Description of Artificial Sequence: Synthetic oligonucleotide
gcccagccuggagcccuca

SEQ ID NO: 10310 - RNA, 19 nt, Artificial Sequence
  Description of Artificial Sequence: Synthetic oligonucleotide
cccagccuggagcccucga

SEQ ID NO: 10311 - RNA, 19 nt, Artificial Sequence
  Description of Artificial Sequence: Synthetic oligonucleotide
ccagccuggagcccucgga

SEQ ID NO: 10312 - RNA, 19 nt, Artificial Sequence
  Description of Artificial Sequence: Synthetic oligonucleotide
cagccuggagcccucggua

SEQ ID NO: 10313 - RNA, 19 nt, Artificial Sequence
  Description of Artificial Sequence: Synthetic oligonucleotide
agccuggagcccucgguga

SEQ ID NO: 10314 - RNA, 19 nt, Artificial Sequence
  Description of Artificial Sequence: Synthetic oligonucleotide
gccuggagcccucggugua

SEQ ID NO: 10315 - RNA, 19 nt, Artificial Sequence
  Description of Artificial Sequence: Synthetic oligonucleotide
ccuggagcccucgguguca

SEQ ID NO: 10316 - RNA, 19 nt, Artificial Sequence
  Description of Artificial Sequence: Synthetic oligonucleotide
cuggagcccucggugucca

SEQ ID NO: 10317 - RNA, 19 nt, Artificial Sequence
  Description of Artificial Sequence: Synthetic oligonucleotide
uggagcccucgguguccca

SEQ ID NO: 10318 - RNA, 19 nt, Artificial Sequence
  Description of Artificial Sequence: Synthetic oligonucleotide
ggagcccucggugucccca

SEQ ID NO: 10319 - RNA, 19 nt, Artificial Sequence
  Description of Artificial Sequence: Synthetic oligonucleotide
gagcccucgguguccccaa

SEQ ID NO: 10320 - RNA, 19 nt, Artificial Sequence
  Description of Artificial Sequence: Synthetic oligonucleotide
agcccucgguguccccaca

SEQ ID NO: 10321 - RNA, 19 nt, Artificial Sequence
  Description of Artificial Sequence: Synthetic oligonucleotide
gcccucgguguccccacaa

SEQ ID NO: 10322 - RNA, 19 nt, Artificial Sequence
  Description of Artificial Sequence: Synthetic oligonucleotide
cccucgguguccccacaga

SEQ ID NO: 10323 - RNA, 19 nt, Artificial Sequence
  Description of Artificial Sequence: Synthetic oligonucleotide
ccucgguguccccacagga

SEQ ID NO: 10324 - RNA, 19 nt, Artificial Sequence
  Description of Artificial Sequence: Synthetic oligonucleotide
cucgguguccccacaggaa

SEQ ID NO: 10325 - RNA, 19 nt, Artificial Sequence
  Description of Artificial Sequence: Synthetic oligonucleotide
ucgguguccccacaggaua

SEQ ID NO: 10326 - RNA, 19 nt, Artificial Sequence
  Description of Artificial Sequence: Synthetic oligonucleotide
cgguguccccacaggauga

SEQ ID NO: 10327 - RNA, 19 nt, Artificial Sequence
  Description of Artificial Sequence: Synthetic oligonucleotide
gguguccccacaggaugaa

SEQ ID NO: 10328 - RNA, 19 nt, Artificial Sequence
  Description of Artificial Sequence: Synthetic oligonucleotide
guguccccacaggaugaaa

SEQ ID NO: 10329 - RNA, 19 nt, Artificial Sequence
  Description of Artificial Sequence: Synthetic oligonucleotide
uguccccacaggaugaaaa

SEQ ID NO: 10330 - RNA, 19 nt, Artificial Sequence
  Description of Artificial Sequence: Synthetic oligonucleotide
guccccacaggaugaaaca

SEQ ID NO: 10331 - RNA, 19 nt, Artificial Sequence
  Description of Artificial Sequence: Synthetic oligonucleotide
uccccacaggaugaaacaa

SEQ ID NO: 10332 - RNA, 19 nt, Artificial Sequence
  Description of Artificial Sequence: Synthetic oligonucleotide
ccccacaggaugaaacaga

SEQ ID NO: 10333 - RNA, 19 nt, Artificial Sequence
  Description of Artificial Sequence: Synthetic oligonucleotide
cccacaggaugaaacagca

SEQ ID NO: 10334 - RNA, 19 nt, Artificial Sequence
  Description of Artificial Sequence: Synthetic oligonucleotide
ccacaggaugaaacagcua

SEQ ID NO: 10335 - RNA, 19 nt, Artificial Sequence
  Description of Artificial Sequence: Synthetic oligonucleotide
cacaggaugaaacagcuga

SEQ ID NO: 10336 - RNA, 19 nt, Artificial Sequence
  Description of Artificial Sequence: Synthetic oligonucleotide
acaggaugaaacagcugaa

SEQ ID NO: 10337 - RNA, 19 nt, Artificial Sequence
  Description of Artificial Sequence: Synthetic oligonucleotide
caggaugaaacagcugaaa

SEQ ID NO: 10338 - RNA, 19 nt, Artificial Sequence
  Description of Artificial Sequence: Synthetic oligonucleotide
aggaugaaacagcugaaga

SEQ ID NO: 10339 - RNA, 19 nt, Artificial Sequence
  Description of Artificial Sequence: Synthetic oligonucleotide
ggaugaaacagcugaagua

SEQ ID NO: 10340 - RNA, 19 nt, Artificial Sequence
  Description of Artificial Sequence: Synthetic oligonucleotide
gaugaaacagcugaaguga

SEQ ID NO: 10341 - RNA, 19 nt, Artificial Sequence
  Description of Artificial Sequence: Synthetic oligonucleotide
augaaacagcugaagugga

SEQ ID NO: 10342 - RNA, 19 nt, Artificial Sequence
  Description of Artificial Sequence: Synthetic oligonucleotide
ugaaacagcugaaguggca

SEQ ID NO: 10343 - RNA, 19 nt, Artificial Sequence
  Description of Artificial Sequence: Synthetic oligonucleotide
gaaacagcugaaguggcaa

SEQ ID NO: 10344 - RNA, 19 nt, Artificial Sequence
  Description of Artificial Sequence: Synthetic oligonucleotide
aaacagcugaaguggcaga

SEQ ID NO: 10345 - RNA, 19 nt, Artificial Sequence
  Description of Artificial Sequence: Synthetic oligonucleotide
aacagcugaaguggcagua

SEQ ID NO: 10346 - RNA, 19 nt, Artificial Sequence
  Description of Artificial Sequence: Synthetic oligonucleotide
acagcugaaguggcaguua

SEQ ID NO: 10347 - RNA, 19 nt, Artificial Sequence
  Description of Artificial Sequence: Synthetic oligonucleotide
cagcugaaguggcaguuca

SEQ ID NO: 10348 - RNA, 19 nt, Artificial Sequence
  Description of Artificial Sequence: Synthetic oligonucleotide
agcugaaguggcaguucca

SEQ ID NO: 10349 - RNA, 19 nt, Artificial Sequence
  Description of Artificial Sequence: Synthetic oligonucleotide
gcugaaguggcaguuccaa

SEQ ID NO: 10350 - RNA, 19 nt, Artificial Sequence
  Description of Artificial Sequence: Synthetic oligonucleotide
cugaaguggcaguuccaga

SEQ ID NO: 10351 - RNA, 19 nt, Artificial Sequence
  Description of Artificial Sequence: Synthetic oligonucleotide
ugaaguggcaguuccagca

SEQ ID NO: 10352 - RNA, 19 nt, Artificial Sequence
  Description of Artificial Sequence: Synthetic oligonucleotide
gaaguggcaguuccagcga

SEQ ID NO: 10353 - RNA, 19 nt, Artificial Sequence
  Description of Artificial Sequence: Synthetic oligonucleotide
aaguggcaguuccagcgga

SEQ ID NO: 10354 - RNA, 19 nt, Artificial Sequence
  Description of Artificial Sequence: Synthetic oligonucleotide
aguggcaguuccagcggca

SEQ ID NO: 10355 - RNA, 19 nt, Artificial Sequence
  Description of Artificial Sequence: Synthetic oligonucleotide
guggcaguuccagcggcua

SEQ ID NO: 10356 - RNA, 19 nt, Artificial Sequence
  Description of Artificial Sequence: Synthetic oligonucleotide
uggcaguuccagcggcuga

SEQ ID NO: 10357 - RNA, 19 nt, Artificial Sequence
  Description of Artificial Sequence: Synthetic oligonucleotide
ggcaguuccagcggcugua

SEQ ID NO: 10358 - RNA, 19 nt, Artificial Sequence
  Description of Artificial Sequence: Synthetic oligonucleotide
gcaguuccagcggcuguca

SEQ ID NO: 10359 - RNA, 19 nt, Artificial Sequence
  Description of Artificial Sequence: Synthetic oligonucleotide
caguuccagcggcugucca

SEQ ID NO: 10360 - RNA, 19 nt, Artificial Sequence
  Description of Artificial Sequence: Synthetic oligonucleotide
aguuccagcggcuguccca

SEQ ID NO: 10361 - RNA, 19 nt, Artificial Sequence
  Description of Artificial Sequence: Synthetic oligonucleotide
guuccagcggcugucccua

SEQ ID NO: 10362 - RNA, 19 nt, Artificial Sequence
  Description of Artificial Sequence: Synthetic oligonucleotide
uuccagcggcugucccuga

SEQ ID NO: 10363 - RNA, 19 nt, Artificial Sequence
  Description of Artificial Sequence: Synthetic oligonucleotide
uccagcggcugucccugca

SEQ ID NO: 10364 - RNA, 19 nt, Artificial Sequence
  Description of Artificial Sequence: Synthetic oligonucleotide
ccagcggcugucccugcga

SEQ ID NO: 10365 - RNA, 19 nt, Artificial Sequence
  Description of Artificial Sequence: Synthetic oligonucleotide
cagcggcugucccugcgga

SEQ ID NO: 10366 - RNA, 19 nt, Artificial Sequence
  Description of Artificial Sequence: Synthetic oligonucleotide
agcggcugucccugcggca

SEQ ID NO: 10367 - RNA, 19 nt, Artificial Sequence
  Description of Artificial Sequence: Synthetic oligonucleotide
gcggcugucccugcggcaa

SEQ ID NO: 10368 - RNA, 19 nt, Artificial Sequence
  Description of Artificial Sequence: Synthetic oligonucleotide
cggcugucccugcggcaga

SEQ ID NO: 10369 - RNA, 19 nt, Artificial Sequence
  Description of Artificial Sequence: Synthetic oligonucleotide
ggcugucccugcggcagaa

SEQ ID NO: 10370 - RNA, 19 nt, Artificial Sequence
  Description of Artificial Sequence: Synthetic oligonucleotide
gcugucccugcggcagaga

SEQ ID NO: 10371 - RNA, 19 nt, Artificial Sequence
  Description of Artificial Sequence: Synthetic oligonucleotide
cugucccugcggcagagga

SEQ ID NO: 10372 - RNA, 19 nt, Artificial Sequence
  Description of Artificial Sequence: Synthetic oligonucleotide
ugucccugcggcagaggca

SEQ ID NO: 10373 - RNA, 19 nt, Artificial Sequence
  Description of Artificial Sequence: Synthetic oligonucleotide
gucccugcggcagaggcua

SEQ ID NO: 10374 - RNA, 19 nt, Artificial Sequence
  Description of Artificial Sequence: Synthetic oligonucleotide
ucccugcggcagaggcuga

SEQ ID NO: 10375 - RNA, 19 nt, Artificial Sequence
  Description of Artificial Sequence: Synthetic oligonucleotide
cccugcggcagaggcugaa

SEQ ID NO: 10376 - RNA, 19 nt, Artificial Sequence
  Description of Artificial Sequence: Synthetic oligonucleotide
ccugcggcagaggcugaga

SEQ ID NO: 10377 - RNA, 19 nt, Artificial Sequence
  Description of Artificial Sequence: Synthetic oligonucleotide
cugcggcagaggcugagga

SEQ ID NO: 10378 - RNA, 19 nt, Artificial Sequence
  Description of Artificial Sequence: Synthetic oligonucleotide
ugcggcagaggcugaggca

SEQ ID NO: 10379 - RNA, 19 nt, Artificial Sequence
  Description of Artificial Sequence: Synthetic oligonucleotide
gcggcagaggcugaggcca

SEQ ID NO: 10380 - RNA, 19 nt, Artificial Sequence
  Description of Artificial Sequence: Synthetic oligonucleotide
cggcagaggcugaggccga

SEQ ID NO: 10381 - RNA, 19 nt, Artificial Sequence
  Description of Artificial Sequence: Synthetic oligonucleotide
ggcagaggcugaggccgaa

SEQ ID NO: 10382 - RNA, 19 nt, Artificial Sequence
  Description of Artificial Sequence: Synthetic oligonucleotide
gcagaggcugaggccgaga

SEQ ID NO: 10383 - RNA, 19 nt, Artificial Sequence
  Description of Artificial Sequence: Synthetic oligonucleotide
cagaggcugaggccgagga

SEQ ID NO: 10384 - RNA, 19 nt, Artificial Sequence
  Description of Artificial Sequence: Synthetic oligonucleotide
agaggcugaggccgaggua

SEQ ID NO: 10385 - RNA, 19 nt, Artificial Sequence
  Description of Artificial Sequence: Synthetic oligonucleotide
gaggcugaggccgagguga

SEQ ID NO: 10386 - RNA, 19 nt, Artificial Sequence
  Description of Artificial Sequence: Synthetic oligonucleotide
aggcugaggccgaggugaa

SEQ ID NO: 10387 - RNA, 19 nt, Artificial Sequence
  Description of Artificial Sequence: Synthetic oligonucleotide
ggcugaggccgaggugaca

SEQ ID NO: 10388 - RNA, 19 nt, Artificial Sequence
  Description of Artificial Sequence: Synthetic oligonucleotide
gcugaggccgaggugacga

SEQ ID NO: 10389 - RNA, 19 nt, Artificial Sequence
  Description of Artificial Sequence: Synthetic oligonucleotide
cugaggccgaggugacgca

SEQ ID NO: 10390 - RNA, 19 nt, Artificial Sequence
  Description of Artificial Sequence: Synthetic oligonucleotide
ugaggccgaggugacgcua

SEQ ID NO: 10391 - RNA, 19 nt, Artificial Sequence
  Description of Artificial Sequence: Synthetic oligonucleotide
gaggccgaggugacgcuga

SEQ ID NO: 10392 - RNA, 19 nt, Artificial Sequence
  Description of Artificial Sequence: Synthetic oligonucleotide
aggccgaggugacgcugca

SEQ ID NO: 10393 - RNA, 19 nt, Artificial Sequence
  Description of Artificial Sequence: Synthetic oligonucleotide
ggccgaggugacgcugcga

SEQ ID NO: 10394 - RNA, 19 nt, Artificial Sequence
  Description of Artificial Sequence: Synthetic oligonucleotide
gccgaggugacgcugcgga

SEQ ID NO: 10395 - RNA, 19 nt, Artificial Sequence
  Description of Artificial Sequence: Synthetic oligonucleotide
ccgaggugacgcugcggga

SEQ ID NO: 10396 - RNA, 19 nt, Artificial Sequence
  Description of Artificial Sequence: Synthetic oligonucleotide
cgaggugacgcugcgggaa

SEQ ID NO: 10397 - RNA, 19 nt, Artificial Sequence
  Description of Artificial Sequence: Synthetic oligonucleotide
gaggugacgcugcgggaga

SEQ ID NO: 10398 - RNA, 19 nt, Artificial Sequence
  Description of Artificial Sequence: Synthetic oligonucleotide
aggugacgcugcgggagca

SEQ ID NO: 10399 - RNA, 19 nt, Artificial Sequence
  Description of Artificial Sequence: Synthetic oligonucleotide
ggugacgcugcgggagcua

SEQ ID NO: 10400 - RNA, 19 nt, Artificial Sequence
  Description of Artificial Sequence: Synthetic oligonucleotide
gugacgcugcgggagcuca

SEQ ID NO: 10401 - RNA, 19 nt, Artificial Sequence
  Description of Artificial Sequence: Synthetic oligonucleotide
ugacgcugcgggagcucca

SEQ ID NO: 10402 - RNA, 19 nt, Artificial Sequence
  Description of Artificial Sequence: Synthetic oligonucleotide
gacgcugcgggagcuccaa

SEQ ID NO: 10403 - RNA, 19 nt, Artificial Sequence
  Description of Artificial Sequence: Synthetic oligonucleotide
acgcugcgggagcuccaga

SEQ ID NO: 10404 - RNA, 19 nt, Artificial Sequence
  Description of Artificial Sequence: Synthetic oligonucleotide
cgcugcgggagcuccagga

SEQ ID NO: 10405 - RNA, 19 nt, Artificial Sequence
  Description of Artificial Sequence: Synthetic oligonucleotide
gcugcgggagcuccaggaa

SEQ ID NO: 10406 - RNA, 19 nt, Artificial Sequence
  Description of Artificial Sequence: Synthetic oligonucleotide
cugcgggagcuccaggaaa

SEQ ID NO: 10407 - RNA, 19 nt, Artificial Sequence
  Description of Artificial Sequence: Synthetic oligonucleotide
ugcgggagcuccaggaaga

SEQ ID NO: 10408 - RNA, 19 nt, Artificial Sequence
  Description of Artificial Sequence: Synthetic oligonucleotide
gcgggagcuccaggaagca

SEQ ID NO: 10409 - RNA, 19 nt, Artificial Sequence
  Description of Artificial Sequence: Synthetic oligonucleotide
cgggagcuccaggaagcca

SEQ ID NO: 10410 - RNA, 19 nt, Artificial Sequence
  Description of Artificial Sequence: Synthetic oligonucleotide
gggagcuccaggaagccca

SEQ ID NO: 10411 - RNA, 19 nt, Artificial Sequence
  Description of Artificial Sequence: Synthetic oligonucleotide
ggagcuccaggaagcccua

SEQ ID NO: 10412 - RNA, 19 nt, Artificial Sequence
  Description of Artificial Sequence: Synthetic oligonucleotide
gagcuccaggaagcccuga

SEQ ID NO: 10413 - RNA, 19 nt, Artificial Sequence
  Description of Artificial Sequence: Synthetic oligonucleotide
agcuccaggaagcccugga

SEQ ID NO: 10414 - RNA, 19 nt, Artificial Sequence
  Description of Artificial Sequence: Synthetic oligonucleotide
gcuccaggaagcccuggaa

SEQ ID NO: 10415 - RNA, 19 nt, Artificial Sequence
  Description of Artificial Sequence: Synthetic oligonucleotide
cuccaggaagcccuggaga

SEQ ID NO: 10416 - RNA, 19 nt, Artificial Sequence
  Description of Artificial Sequence: Synthetic oligonucleotide
uccaggaagcccuggagga

SEQ ID NO: 10417 - RNA, 19 nt, Artificial Sequence
  Description of Artificial Sequence: Synthetic oligonucleotide
ccaggaagcccuggaggaa

SEQ ID NO: 10418 - RNA, 19 nt, Artificial Sequence
  Description of Artificial Sequence: Synthetic oligonucleotide
caggaagcccuggaggaga

SEQ ID NO: 10419 - RNA, 19 nt, Artificial Sequence
  Description of Artificial Sequence: Synthetic oligonucleotide
aggaagcccuggaggagga

SEQ ID NO: 10420 - RNA, 19 nt, Artificial Sequence
  Description of Artificial Sequence: Synthetic oligonucleotide
ggaagcccuggaggaggaa

SEQ ID NO: 10421 - RNA, 19 nt, Artificial Sequence
  Description of Artificial Sequence: Synthetic oligonucleotide
gaagcccuggaggaggaga

SEQ ID NO: 10422 - RNA, 19 nt, Artificial Sequence
  Description of Artificial Sequence: Synthetic oligonucleotide
aagcccuggaggaggagga

SEQ ID NO: 10423 - RNA, 19 nt, Artificial Sequence
  Description of Artificial Sequence: Synthetic oligonucleotide
agcccuggaggaggaggua

SEQ ID NO: 10424 - RNA, 19 nt, Artificial Sequence
  Description of Artificial Sequence: Synthetic oligonucleotide
gcccuggaggaggagguga

SEQ ID NO: 10425 - RNA, 19 nt, Artificial Sequence
  Description of Artificial Sequence: Synthetic oligonucleotide
cccuggaggaggaggugca

SEQ ID NO: 10426 - RNA, 19 nt, Artificial Sequence
  Description of Artificial Sequence: Synthetic oligonucleotide
ccuggaggaggaggugcua

SEQ ID NO: 10427 - RNA, 19 nt, Artificial Sequence
  Description of Artificial Sequence: Synthetic oligonucleotide
cuggaggaggaggugcuca

SEQ ID NO: 10428 - RNA, 19 nt, Artificial Sequence
  Description of Artificial Sequence: Synthetic oligonucleotide
uggaggaggaggugcucaa

SEQ ID NO: 10429 - RNA, 19 nt, Artificial Sequence
  Description of Artificial Sequence: Synthetic oligonucleotide
ggaggaggaggugcucaca

SEQ ID NO: 10430 - RNA, 19 nt, Artificial Sequence
  Description of Artificial Sequence: Synthetic oligonucleotide
gaggaggaggugcucacca

SEQ ID NO: 10431 - RNA, 19 nt, Artificial Sequence
  Description of Artificial Sequence: Synthetic oligonucleotide
aggaggaggugcucaccca

SEQ ID NO: 10432 - RNA, 19 nt, Artificial Sequence
  Description of Artificial Sequence: Synthetic oligonucleotide
ggaggaggugcucacccga

SEQ ID NO: 10433 - RNA, 19 nt, Artificial Sequence
  Description of Artificial Sequence: Synthetic oligonucleotide
gaggaggugcucacccgga

SEQ ID NO: 10434 - RNA, 19 nt, Artificial Sequence
  Description of Artificial Sequence: Synthetic oligonucleotide
aggaggugcucacccggca

SEQ ID NO: 10435 - RNA, 19 nt, Artificial Sequence
  Description of Artificial Sequence: Synthetic oligonucleotide
ggaggugcucacccggcaa

SEQ ID NO: 10436 - RNA, 19 nt, Artificial Sequence
  Description of Artificial Sequence: Synthetic oligonucleotide
gaggugcucacccggcaga

SEQ ID NO: 10437 - RNA, 19 nt, Artificial Sequence
  Description of Artificial Sequence: Synthetic oligonucleotide
aggugcucacccggcagaa

SEQ ID NO: 10438 - RNA, 19 nt, Artificial Sequence
  Description of Artificial Sequence: Synthetic oligonucleotide
ggugcucacccggcagaga

SEQ ID NO: 10439 - RNA, 19 nt, Artificial Sequence
  Description of Artificial Sequence: Synthetic oligonucleotide
gugcucacccggcagagca

SEQ ID NO: 10440 - RNA, 19 nt, Artificial Sequence
  Description of Artificial Sequence: Synthetic oligonucleotide
ugcucacccggcagagcca

SEQ ID NO: 10441 - RNA, 19 nt, Artificial Sequence
  Description of Artificial Sequence: Synthetic oligonucleotide
gcucacccggcagagccua

SEQ ID NO: 10442 - RNA, 19 nt, Artificial Sequence
  Description of Artificial Sequence: Synthetic oligonucleotide
cucacccggcagagccuga

SEQ ID NO: 10443 - RNA, 19 nt, Artificial Sequence
  Description of Artificial Sequence: Synthetic oligonucleotide
ucacccggcagagccugaa

SEQ ID NO: 10444 - RNA, 19 nt, Artificial Sequence
  Description of Artificial Sequence: Synthetic oligonucleotide
cacccggcagagccugaga

SEQ ID NO: 10445 - RNA, 19 nt, Artificial Sequence
  Description of Artificial Sequence: Synthetic oligonucleotide
acccggcagagccugagca

SEQ ID NO: 10446 - RNA, 19 nt, Artificial Sequence
  Description of Artificial Sequence: Synthetic oligonucleotide
cccggcagagccugagcca

SEQ ID NO: 10447 - RNA, 19 nt, Artificial Sequence
  Description of Artificial Sequence: Synthetic oligonucleotide
ccggcagagccugagccga

SEQ ID NO: 10448 - RNA, 19 nt, Artificial Sequence
  Description of Artificial Sequence: Synthetic oligonucleotide
cggcagagccugagccgga

SEQ ID NO: 10449 - RNA, 19 nt, Artificial Sequence
  Description of Artificial Sequence: Synthetic oligonucleotide
ggcagagccugagccggga

SEQ ID NO: 10450 - RNA, 19 nt, Artificial Sequence
  Description of Artificial Sequence: Synthetic oligonucleotide
gcagagccugagccgggaa

SEQ ID NO: 10451 - RNA, 19 nt, Artificial Sequence
  Description of Artificial Sequence: Synthetic oligonucleotide
cagagccugagccgggaga

SEQ ID NO: 10452 - RNA, 19 nt, Artificial Sequence
  Description of Artificial Sequence: Synthetic oligonucleotide
agagccugagccgggagaa

SEQ ID NO: 10453 - RNA, 19 nt, Artificial Sequence
  Description of Artificial Sequence: Synthetic oligonucleotide
gagccugagccgggagaua

SEQ ID NO: 10454 - RNA, 19 nt, Artificial Sequence
  Description of Artificial Sequence: Synthetic oligonucleotide
agccugagccgggagauga

SEQ ID NO: 10455 - RNA, 19 nt, Artificial Sequence
  Description of Artificial Sequence: Synthetic oligonucleotide
gccugagccgggagaugga

SEQ ID NO: 10456 - RNA, 19 nt, Artificial Sequence
  Description of Artificial Sequence: Synthetic oligonucleotide
ccugagccgggagauggaa

SEQ ID NO: 10457 - RNA, 19 nt, Artificial Sequence
  Description of Artificial Sequence: Synthetic oligonucleotide
cugagccgggagauggaga

SEQ ID NO: 10458 - RNA, 19 nt, Artificial Sequence
  Description of Artificial Sequence: Synthetic oligonucleotide
ugagccgggagauggagga

SEQ ID NO: 10459 - RNA, 19 nt, Artificial Sequence
  Description of Artificial Sequence: Synthetic oligonucleotide
gagccgggagauggaggca

SEQ ID NO: 10460 - RNA, 19 nt, Artificial Sequence
  Description of Artificial Sequence: Synthetic oligonucleotide
agccgggagauggaggcca

SEQ ID NO: 10461 - RNA, 19 nt, Artificial Sequence
  Description of Artificial Sequence: Synthetic oligonucleotide
gccgggagauggaggccaa

SEQ ID NO: 10462 - RNA, 19 nt, Artificial Sequence
  Description of Artificial Sequence: Synthetic oligonucleotide
ccgggagauggaggccaua

SEQ ID NO: 10463 - RNA, 19 nt, Artificial Sequence
  Description of Artificial Sequence: Synthetic oligonucleotide
cgggagauggaggccauca

SEQ ID NO: 10464 - RNA, 19 nt, Artificial Sequence
  Description of Artificial Sequence: Synthetic oligonucleotide
gggagauggaggccaucca

SEQ ID NO: 10465 - RNA, 19 nt, Artificial Sequence
  Description of Artificial Sequence: Synthetic oligonucleotide
ggagauggaggccauccga

SEQ ID NO: 10466 - RNA, 19 nt, Artificial Sequence
  Description of Artificial Sequence: Synthetic oligonucleotide
gagauggaggccauccgca

SEQ ID NO: 10467 - RNA, 19 nt, Artificial Sequence
  Description of Artificial Sequence: Synthetic oligonucleotide
agauggaggccauccgcaa

SEQ ID NO: 10468 - RNA, 19 nt, Artificial Sequence
  Description of Artificial Sequence: Synthetic oligonucleotide
gauggaggccauccgcaca

SEQ ID NO: 10469 - RNA, 19 nt, Artificial Sequence
  Description of Artificial Sequence: Synthetic oligonucleotide
auggaggccauccgcacga

SEQ ID NO: 10470 - RNA, 19 nt, Artificial Sequence
  Description of Artificial Sequence: Synthetic oligonucleotide
uggaggccauccgcacgga

SEQ ID NO: 10471 - RNA, 19 nt, Artificial Sequence
  Description of Artificial Sequence: Synthetic oligonucleotide
ggaggccauccgcacggaa

SEQ ID NO: 10472 - RNA, 19 nt, Artificial Sequence
  Description of Artificial Sequence: Synthetic oligonucleotide
gaggccauccgcacggaca

SEQ ID NO: 10473 - RNA, 19 nt, Artificial Sequence
  Description of Artificial Sequence: Synthetic oligonucleotide
aggccauccgcacggacaa

SEQ ID NO: 10474 - RNA, 19 nt, Artificial Sequence
  Description of Artificial Sequence: Synthetic oligonucleotide
ggccauccgcacggacaaa

SEQ ID NO: 10475 - RNA, 19 nt, Artificial Sequence
  Description of Artificial Sequence: Synthetic oligonucleotide
gccauccgcacggacaaca

SEQ ID NO: 10476 - RNA, 19 nt, Artificial Sequence
  Description of Artificial Sequence: Synthetic oligonucleotide
ccauccgcacggacaacca

SEQ ID NO: 10477 - RNA, 19 nt, Artificial Sequence
  Description of Artificial Sequence: Synthetic oligonucleotide
cauccgcacggacaaccaa

SEQ ID NO: 10478 - RNA, 19 nt, Artificial Sequence
  Description of Artificial Sequence: Synthetic oligonucleotide
auccgcacggacaaccaga

SEQ ID NO: 10479 - RNA, 19 nt, Artificial Sequence
  Description of Artificial Sequence: Synthetic oligonucleotide
uccgcacggacaaccagaa

SEQ ID NO: 10480 - RNA, 19 nt, Artificial Sequence
  Description of Artificial Sequence: Synthetic oligonucleotide
ccgcacggacaaccagaaa

SEQ ID NO: 10481 - RNA, 19 nt, Artificial Sequence
  Description of Artificial Sequence: Synthetic oligonucleotide
cgcacggacaaccagaaca

SEQ ID NO: 10482 - RNA, 19 nt, Artificial Sequence
  Description of Artificial Sequence: Synthetic oligonucleotide
gcacggacaaccagaacua

SEQ ID NO: 10483 - RNA, 19 nt, Artificial Sequence
  Description of Artificial Sequence: Synthetic oligonucleotide
cacggacaaccagaacuua

SEQ ID NO: 10484 - RNA, 19 nt, Artificial Sequence
  Description of Artificial Sequence: Synthetic oligonucleotide
acggacaaccagaacuuca

SEQ ID NO: 10485 - RNA, 19 nt, Artificial Sequence
  Description of Artificial Sequence: Synthetic oligonucleotide
cggacaaccagaacuucga

SEQ ID NO: 10486 - RNA, 19 nt, Artificial Sequence
  Description of Artificial Sequence: Synthetic oligonucleotide
ggacaaccagaacuucgca

SEQ ID NO: 10487 - RNA, 19 nt, Artificial Sequence
  Description of Artificial Sequence: Synthetic oligonucleotide
gacaaccagaacuucgcca

SEQ ID NO: 10488 - RNA, 19 nt, Artificial Sequence
  Description of Artificial Sequence: Synthetic oligonucleotide
acaaccagaacuucgccaa

SEQ ID NO: 10489 - RNA, 19 nt, Artificial Sequence
  Description of Artificial Sequence: Synthetic oligonucleotide
caaccagaacuucgccaga

SEQ ID NO: 10490 - RNA, 19 nt, Artificial Sequence
  Description of Artificial Sequence: Synthetic oligonucleotide
aaccagaacuucgccagua

SEQ ID NO: 10491 - RNA, 19 nt, Artificial Sequence
  Description of Artificial Sequence: Synthetic oligonucleotide
accagaacuucgccaguca

SEQ ID NO: 10492 - RNA, 19 nt, Artificial Sequence
  Description of Artificial Sequence: Synthetic oligonucleotide
ccagaacuucgccagucaa

SEQ ID NO: 10493 - RNA, 19 nt, Artificial Sequence
  Description of Artificial Sequence: Synthetic oligonucleotide
cagaacuucgccagucaaa

SEQ ID NO: 10494 - RNA, 19 nt, Artificial Sequence
  Description of Artificial Sequence: Synthetic oligonucleotide
agaacuucgccagucaaca

SEQ ID NO: 10495 - RNA, 19 nt, Artificial Sequence
  Description of Artificial Sequence: Synthetic oligonucleotide
gaacuucgccagucaacua

SEQ ID NO: 10496 - RNA, 19 nt, Artificial Sequence
  Description of Artificial Sequence: Synthetic oligonucleotide
aacuucgccagucaacuaa

SEQ ID NO: 10497 - RNA, 19 nt, Artificial Sequence
  Description of Artificial Sequence: Synthetic oligonucleotide
acuucgccagucaacuaca

SEQ ID NO: 10498 - RNA, 19 nt, Artificial Sequence
  Description of Artificial Sequence: Synthetic oligonucleotide
cuucgccagucaacuacga

SEQ ID NO: 10499 - RNA, 19 nt, Artificial Sequence
  Description of Artificial Sequence: Synthetic oligonucleotide
uucgccagucaacuacgca

SEQ ID NO: 10500 - RNA, 19 nt, Artificial Sequence
  Description of Artificial Sequence: Synthetic oligonucleotide
ucgccagucaacuacgcga

SEQ ID NO: 10501 - RNA, 19 nt, Artificial Sequence
  Description of Artificial Sequence: Synthetic oligonucleotide
cgccagucaacuacgcgaa

SEQ ID NO: 10502 - RNA, 19 nt, Artificial Sequence
  Description of Artificial Sequence: Synthetic oligonucleotide
gccagucaacuacgcgaga

SEQ ID NO: 10503 - RNA, 19 nt, Artificial Sequence
  Description of Artificial Sequence: Synthetic oligonucleotide
ccagucaacuacgcgagga

SEQ ID NO: 10504 - RNA, 19 nt, Artificial Sequence
  Description of Artificial Sequence: Synthetic oligonucleotide
cagucaacuacgcgaggca

SEQ ID NO: 10505 - RNA, 19 nt, Artificial Sequence
  Description of Artificial Sequence: Synthetic oligonucleotide
agucaacuacgcgaggcaa

SEQ ID NO: 10506 - RNA, 19 nt, Artificial Sequence
  Description of Artificial Sequence: Synthetic oligonucleotide
gucaacuacgcgaggcaga

SEQ ID NO: 10507 - RNA, 19 nt, Artificial Sequence
  Description of Artificial Sequence: Synthetic oligonucleotide
ucaacuacgcgaggcagaa

SEQ ID NO: 10508 - RNA, 19 nt, Artificial Sequence
  Description of Artificial Sequence: Synthetic oligonucleotide
caacuacgcgaggcagaga

SEQ ID NO: 10509 - RNA, 19 nt, Artificial Sequence
  Description of Artificial Sequence: Synthetic oligonucleotide
aacuacgcgaggcagagga

SEQ ID NO: 10510 - RNA, 19 nt, Artificial Sequence
  Description of Artificial Sequence: Synthetic oligonucleotide
acuacgcgaggcagaggca

SEQ ID NO: 10511 - RNA, 19 nt, Artificial Sequence
  Description of Artificial Sequence: Synthetic oligonucleotide
cuacgcgaggcagaggcua

SEQ ID NO: 10512 - RNA, 19 nt, Artificial Sequence
  Description of Artificial Sequence: Synthetic oligonucleotide
uacgcgaggcagaggcuca

SEQ ID NO: 10513 - RNA, 19 nt, Artificial Sequence
  Description of Artificial Sequence: Synthetic oligonucleotide
acgcgaggcagaggcucga

SEQ ID NO: 10514 - RNA, 19 nt, Artificial Sequence
  Description of Artificial Sequence: Synthetic oligonucleotide
cgcgaggcagaggcucgga

SEQ ID NO: 10515 - RNA, 19 nt, Artificial Sequence
  Description of Artificial Sequence: Synthetic oligonucleotide
gcgaggcagaggcucggaa

SEQ ID NO: 10516 - RNA, 19 nt, Artificial Sequence
  Description of Artificial Sequence: Synthetic oligonucleotide
cgaggcagaggcucggaaa

SEQ ID NO: 10517 - RNA, 19 nt, Artificial Sequence
  Description of Artificial Sequence: Synthetic oligonucleotide
gaggcagaggcucggaaca

SEQ ID NO: 10518 - RNA, 19 nt, Artificial Sequence
  Description of Artificial Sequence: Synthetic oligonucleotide
aggcagaggcucggaacca

SEQ ID NO: 10519 - RNA, 19 nt, Artificial Sequence
  Description of Artificial Sequence: Synthetic oligonucleotide
ggcagaggcucggaaccga

SEQ ID NO: 10520 - RNA, 19 nt, Artificial Sequence
  Description of Artificial Sequence: Synthetic oligonucleotide
gcagaggcucggaaccgga

SEQ ID NO: 10521 - RNA, 19 nt, Artificial Sequence
  Description of Artificial Sequence: Synthetic oligonucleotide
cagaggcucggaaccggga

SEQ ID NO: 10522 - RNA, 19 nt, Artificial Sequence
  Description of Artificial Sequence: Synthetic oligonucleotide
agaggcucggaaccgggaa

SEQ ID NO: 10523 - RNA, 19 nt, Artificial Sequence
  Description of Artificial Sequence: Synthetic oligonucleotide
gaggcucggaaccgggaca

SEQ ID NO: 10524 - RNA, 19 nt, Artificial Sequence
  Description of Artificial Sequence: Synthetic oligonucleotide
aggcucggaaccgggacca

SEQ ID NO: 10525 - RNA, 19 nt, Artificial Sequence
  Description of Artificial Sequence: Synthetic oligonucleotide
ggcucggaaccgggaccua

SEQ ID NO: 10526 - RNA, 19 nt, Artificial Sequence
  Description of Artificial Sequence: Synthetic oligonucleotide
gcucggaaccgggaccuaa

SEQ ID NO: 10527 - RNA, 19 nt, Artificial Sequence
  Description of Artificial Sequence: Synthetic oligonucleotide
cucggaaccgggaccuaga

SEQ ID NO: 10528 - RNA, 19 nt, Artificial Sequence
  Description of Artificial Sequence: Synthetic oligonucleotide
ucggaaccgggaccuagaa

SEQ ID NO: 10529 - RNA, 19 nt, Artificial Sequence
  Description of Artificial Sequence: Synthetic oligonucleotide
cggaaccgggaccuagaga

SEQ ID NO: 10530 - RNA, 19 nt, Artificial Sequence
  Description of Artificial Sequence: Synthetic oligonucleotide
ggaaccgggaccuagagga

SEQ ID NO: 10531 - RNA, 19 nt, Artificial Sequence
  Description of Artificial Sequence: Synthetic oligonucleotide
gaaccgggaccuagaggca

SEQ ID NO: 10532 - RNA, 19 nt, Artificial Sequence
  Description of Artificial Sequence: Synthetic oligonucleotide
aaccgggaccuagaggcaa

SEQ ID NO: 10533 - RNA, 19 nt, Artificial Sequence
  Description of Artificial Sequence: Synthetic oligonucleotide
accgggaccuagaggcaca

SEQ ID NO: 10534 - RNA, 19 nt, Artificial Sequence
  Description of Artificial Sequence: Synthetic oligonucleotide
ccgggaccuagaggcacaa

SEQ ID NO: 10535 - RNA, 19 nt, Artificial Sequence
  Description of Artificial Sequence: Synthetic oligonucleotide
cgggaccuagaggcacaca

SEQ ID NO: 10536 - RNA, 19 nt, Artificial Sequence
  Description of Artificial Sequence: Synthetic oligonucleotide
gggaccuagaggcacacga

SEQ ID NO: 10537 - RNA, 19 nt, Artificial Sequence
  Description of Artificial Sequence: Synthetic oligonucleotide
ggaccuagaggcacacgua

SEQ ID NO: 10538 - RNA, 19 nt, Artificial Sequence
  Description of Artificial Sequence: Synthetic oligonucleotide
gaccuagaggcacacguca

SEQ ID NO: 10539 - RNA, 19 nt, Artificial Sequence
  Description of Artificial Sequence: Synthetic oligonucleotide
accuagaggcacacgucca

SEQ ID NO: 10540 - RNA, 19 nt, Artificial Sequence
  Description of Artificial Sequence: Synthetic oligonucleotide
ccuagaggcacacguccga

SEQ ID NO: 10541 - RNA, 19 nt, Artificial Sequence
  Description of Artificial Sequence: Synthetic oligonucleotide
cuagaggcacacguccgga

SEQ ID NO: 10542 - RNA, 19 nt, Artificial Sequence
  Description of Artificial Sequence: Synthetic oligonucleotide
uagaggcacacguccggca

SEQ ID NO: 10543 - RNA, 19 nt, Artificial Sequence
  Description of Artificial Sequence: Synthetic oligonucleotide
agaggcacacguccggcaa

SEQ ID NO: 10544 - RNA, 19 nt, Artificial Sequence
  Description of Artificial Sequence: Synthetic oligonucleotide
gaggcacacguccggcaga

SEQ ID NO: 10545 - RNA, 19 nt, Artificial Sequence
  Description of Artificial Sequence: Synthetic oligonucleotide
aggcacacguccggcagua

SEQ ID NO: 10546 - RNA, 19 nt, Artificial Sequence
  Description of Artificial Sequence: Synthetic oligonucleotide
ggcacacguccggcaguua

SEQ ID NO: 10547 - RNA, 19 nt, Artificial Sequence
  Description of Artificial Sequence: Synthetic oligonucleotide
gcacacguccggcaguuga

SEQ ID NO: 10548 - RNA, 19 nt, Artificial Sequence
  Description of Artificial Sequence: Synthetic oligonucleotide
cacacguccggcaguugca

SEQ ID NO: 10549 - RNA, 19 nt, Artificial Sequence
  Description of Artificial Sequence: Synthetic oligonucleotide
acacguccggcaguugcaa

SEQ ID NO: 10550 - RNA, 19 nt, Artificial Sequence
  Description of Artificial Sequence: Synthetic oligonucleotide
cacguccggcaguugcaga

SEQ ID NO: 10551 - RNA, 19 nt, Artificial Sequence
  Description of Artificial Sequence: Synthetic oligonucleotide
acguccggcaguugcagga

SEQ ID NO: 10552 - RNA, 19 nt, Artificial Sequence
  Description of Artificial Sequence: Synthetic oligonucleotide
cguccggcaguugcaggaa

SEQ ID NO: 10553 - RNA, 19 nt, Artificial Sequence
  Description of Artificial Sequence: Synthetic oligonucleotide
guccggcaguugcaggaga

SEQ ID NO: 10554 - RNA, 19 nt, Artificial Sequence
  Description of Artificial Sequence: Synthetic oligonucleotide
uccggcaguugcaggagca

SEQ ID NO: 10555 - RNA, 19 nt, Artificial Sequence
  Description of Artificial Sequence: Synthetic oligonucleotide
ccggcaguugcaggagcga

SEQ ID NO: 10556 - RNA, 19 nt, Artificial Sequence
  Description of Artificial Sequence: Synthetic oligonucleotide
cggcaguugcaggagcgga

SEQ ID NO: 10557 - RNA, 19 nt, Artificial Sequence
  Description of Artificial Sequence: Synthetic oligonucleotide
ggcaguugcaggagcggaa

SEQ ID NO: 10558 - RNA, 19 nt, Artificial Sequence
  Description of Artificial Sequence: Synthetic oligonucleotide
gcaguugcaggagcggaua

SEQ ID NO: 10559 - RNA, 19 nt, Artificial Sequence
  Description of Artificial Sequence: Synthetic oligonucleotide
caguugcaggagcggauga

SEQ ID NO: 10560 - RNA, 19 nt, Artificial Sequence
  Description of Artificial Sequence: Synthetic oligonucleotide
aguugcaggagcggaugga

SEQ ID NO: 10561 - RNA, 19 nt, Artificial Sequence
  Description of Artificial Sequence: Synthetic oligonucleotide
guugcaggagcggauggaa

SEQ ID NO: 10562 - RNA, 19 nt, Artificial Sequence
  Description of Artificial Sequence: Synthetic oligonucleotide
uugcaggagcggauggaga

SEQ ID NO: 10563 - RNA, 19 nt, Artificial Sequence
  Description of Artificial Sequence: Synthetic oligonucleotide
ugcaggagcggauggagua

SEQ ID NO: 10564 - RNA, 19 nt, Artificial Sequence
  Description of Artificial Sequence: Synthetic oligonucleotide
gcaggagcggauggaguua

SEQ ID NO: 10565 - RNA, 19 nt, Artificial Sequence
  Description of Artificial Sequence: Synthetic oligonucleotide
caggagcggauggaguuga

SEQ ID NO: 10566 - RNA, 19 nt, Artificial Sequence
  Description of Artificial Sequence: Synthetic oligonucleotide
aggagcggauggaguugca

SEQ ID NO: 10567 - RNA, 19 nt, Artificial Sequence
  Description of Artificial Sequence: Synthetic oligonucleotide
ggagcggauggaguugcua

SEQ ID NO: 10568 - RNA, 19 nt, Artificial Sequence
  Description of Artificial Sequence: Synthetic oligonucleotide
gagcggauggaguugcuga

SEQ ID NO: 10569 - RNA, 19 nt, Artificial Sequence
  Description of Artificial Sequence: Synthetic oligonucleotide
agcggauggaguugcugca

SEQ ID NO: 10570 - RNA, 19 nt, Artificial Sequence
  Description of Artificial Sequence: Synthetic oligonucleotide
gcggauggaguugcugcaa

SEQ ID NO: 10571 - RNA, 19 nt, Artificial Sequence
  Description of Artificial Sequence: Synthetic oligonucleotide
cggauggaguugcugcaga

SEQ ID NO: 10572 - RNA, 19 nt, Artificial Sequence
  Description of Artificial Sequence: Synthetic oligonucleotide
ggauggaguugcugcagga

SEQ ID NO: 10573 - RNA, 19 nt, Artificial Sequence
  Description of Artificial Sequence: Synthetic oligonucleotide
gauggaguugcugcaggca

SEQ ID NO: 10574 - RNA, 19 nt, Artificial Sequence
  Description of Artificial Sequence: Synthetic oligonucleotide
auggaguugcugcaggcaa

SEQ ID NO: 10575 - RNA, 19 nt, Artificial Sequence
  Description of Artificial Sequence: Synthetic oligonucleotide
uggaguugcugcaggcaga

SEQ ID NO: 10576 - RNA, 19 nt, Artificial Sequence
  Description of Artificial Sequence: Synthetic oligonucleotide
ggaguugcugcaggcagaa

SEQ ID NO: 10577 - RNA, 19 nt, Artificial Sequence
  Description of Artificial Sequence: Synthetic oligonucleotide
gaguugcugcaggcagaga

SEQ ID NO: 10578 - RNA, 19 nt, Artificial Sequence
  Description of Artificial Sequence: Synthetic oligonucleotide
aguugcugcaggcagagga

SEQ ID NO: 10579 - RNA, 19 nt, Artificial Sequence
  Description of Artificial Sequence: Synthetic oligonucleotide
guugcugcaggcagaggga

SEQ ID NO: 10580 - RNA, 19 nt, Artificial Sequence
  Description of Artificial Sequence: Synthetic oligonucleotide
uugcugcaggcagagggaa

SEQ ID NO: 10581 - RNA, 19 nt, Artificial Sequence
  Description of Artificial Sequence: Synthetic oligonucleotide
ugcugcaggcagagggaga

SEQ ID NO: 10582 - RNA, 19 nt, Artificial Sequence
  Description of Artificial Sequence: Synthetic oligonucleotide
gcugcaggcagagggagca

SEQ ID NO: 10583 - RNA, 19 nt, Artificial Sequence
  Description of Artificial Sequence: Synthetic oligonucleotide
cugcaggcagagggagcca

SEQ ID NO: 10584 - RNA, 19 nt, Artificial Sequence
  Description of Artificial Sequence: Synthetic oligonucleotide
ugcaggcagagggagccaa

SEQ ID NO: 10585 - RNA, 19 nt, Artificial Sequence
  Description of Artificial Sequence: Synthetic oligonucleotide
gcaggcagagggagccaca

SEQ ID NO: 10586 - RNA, 19 nt, Artificial Sequence
  Description of Artificial Sequence: Synthetic oligonucleotide
caggcagagggagccacaa

SEQ ID NO: 10587 - RNA, 19 nt, Artificial Sequence
  Description of Artificial Sequence: Synthetic oligonucleotide
aggcagagggagccacaga

SEQ ID NO: 10588 - RNA, 19 nt, Artificial Sequence
  Description of Artificial Sequence: Synthetic oligonucleotide
ggcagagggagccacagga

SEQ ID NO: 10589 - RNA, 19 nt, Artificial Sequence
  Description of Artificial Sequence: Synthetic oligonucleotide
gcagagggagccacaggua

SEQ ID NO: 10590 - RNA, 19 nt, Artificial Sequence
  Description of Artificial Sequence: Synthetic oligonucleotide
cagagggagccacagguca

SEQ ID NO: 10591 - RNA, 19 nt, Artificial Sequence
  Description of Artificial Sequence: Synthetic oligonucleotide
agagggagccacaggucca

SEQ ID NO: 10592 - RNA, 19 nt, Artificial Sequence
  Description of Artificial Sequence: Synthetic oligonucleotide
gagggagccacagguccca

SEQ ID NO: 10593 - RNA, 19 nt, Artificial Sequence
  Description of Artificial Sequence: Synthetic oligonucleotide
agggagccacaggucccua

SEQ ID NO: 10594 - RNA, 19 nt, Artificial Sequence
  Description of Artificial Sequence: Synthetic oligonucleotide
gggagccacaggucccuaa

SEQ ID NO: 10595 - RNA, 19 nt, Artificial Sequence
  Description of Artificial Sequence: Synthetic oligonucleotide
ggagccacaggucccuaga

SEQ ID NO: 10596 - RNA, 19 nt, Artificial Sequence
  Description of Artificial Sequence: Synthetic oligonucleotide
gagccacaggucccuagga

SEQ ID NO: 10597 - RNA, 19 nt, Artificial Sequence
  Description of Artificial Sequence: Synthetic oligonucleotide
agccacaggucccuaggca

SEQ ID NO: 10598 - RNA, 19 nt, Artificial Sequence
  Description of Artificial Sequence: Synthetic oligonucleotide
gccacaggucccuaggcca

SEQ ID NO: 10599 - RNA, 19 nt, Artificial Sequence
  Description of Artificial Sequence: Synthetic oligonucleotide
ccacaggucccuaggccua

SEQ ID NO: 10600 - RNA, 19 nt, Artificial Sequence
  Description of Artificial Sequence: Synthetic oligonucleotide
cacaggucccuaggccuga

SEQ ID NO: 10601 - RNA, 19 nt, Artificial Sequence
  Description of Artificial Sequence: Synthetic oligonucleotide
acaggucccuaggccugga

SEQ ID NO: 10602 - RNA, 19 nt, Artificial Sequence
  Description of Artificial Sequence: Synthetic oligonucleotide
caggucccuaggccuggca

SEQ ID NO: 10603 - RNA, 19 nt, Artificial Sequence
  Description of Artificial Sequence: Synthetic oligonucleotide
aggucccuaggccuggcca

SEQ ID NO: 10604 - RNA, 19 nt, Artificial Sequence
  Description of Artificial Sequence: Synthetic oligonucleotide
ggucccuaggccuggccua

SEQ ID NO: 10605 - RNA, 19 nt, Artificial Sequence
  Description of Artificial Sequence: Synthetic oligonucleotide
gucccuaggccuggccuaa

SEQ ID NO: 10606 - RNA, 19 nt, Artificial Sequence
  Description of Artificial Sequence: Synthetic oligonucleotide
ucccuaggccuggccuaua

SEQ ID NO: 10607 - RNA, 19 nt, Artificial Sequence
  Description of Artificial Sequence: Synthetic oligonucleotide
cccuaggccuggccuauca

SEQ ID NO: 10608 - RNA, 19 nt, Artificial Sequence
  Description of Artificial Sequence: Synthetic oligonucleotide
ccuaggccuggccuaucga

SEQ ID NO: 10609 - RNA, 19 nt, Artificial Sequence
  Description of Artificial Sequence: Synthetic oligonucleotide
cuaggccuggccuaucgga

SEQ ID NO: 10610 - RNA, 19 nt, Artificial Sequence
  Description of Artificial Sequence: Synthetic oligonucleotide
uaggccuggccuaucggaa

SEQ ID NO: 10611 - RNA, 19 nt, Artificial Sequence
  Description of Artificial Sequence: Synthetic oligonucleotide
aggccuggccuaucggaga

SEQ ID NO: 10612 - RNA, 19 nt, Artificial Sequence
  Description of Artificial Sequence: Synthetic oligonucleotide
ggccuggccuaucggagga

SEQ ID NO: 10613 - RNA, 19 nt, Artificial Sequence
  Description of Artificial Sequence: Synthetic oligonucleotide
gccuggccuaucggaggca

SEQ ID NO: 10614 - RNA, 19 nt, Artificial Sequence
  Description of Artificial Sequence: Synthetic oligonucleotide
ccuggccuaucggaggcga

SEQ ID NO: 10615 - RNA, 19 nt, Artificial Sequence
  Description of Artificial Sequence: Synthetic oligonucleotide
cuggccuaucggaggcgca

SEQ ID NO: 10616 - RNA, 19 nt, Artificial Sequence
  Description of Artificial Sequence: Synthetic oligonucleotide
uggccuaucggaggcgcua

SEQ ID NO: 10617 - RNA, 19 nt, Artificial Sequence
  Description of Artificial Sequence: Synthetic oligonucleotide
ggccuaucggaggcgcuua

SEQ ID NO: 10618 - RNA, 19 nt, Artificial Sequence
  Description of Artificial Sequence: Synthetic oligonucleotide
gccuaucggaggcgcuuua

SEQ ID NO: 10619 - RNA, 19 nt, Artificial Sequence
  Description of Artificial Sequence: Synthetic oligonucleotide
ccuaucggaggcgcuuuca

SEQ ID NO: 10620 - RNA, 19 nt, Artificial Sequence
  Description of Artificial Sequence: Synthetic oligonucleotide
cuaucggaggcgcuuucca

SEQ ID NO: 10621 - RNA, 19 nt, Artificial Sequence
  Description of Artificial Sequence: Synthetic oligonucleotide
uaucggaggcgcuuuccca

SEQ ID NO: 10622 - RNA, 19 nt, Artificial Sequence
  Description of Artificial Sequence: Synthetic oligonucleotide
aucggaggcgcuuucccua

SEQ ID NO: 10623 - RNA, 19 nt, Artificial Sequence
  Description of Artificial Sequence: Synthetic oligonucleotide
ucggaggcgcuuucccuga

SEQ ID NO: 10624 - RNA, 19 nt, Artificial Sequence
  Description of Artificial Sequence: Synthetic oligonucleotide
cggaggcgcuuucccugca

SEQ ID NO: 10625 - RNA, 19 nt, Artificial Sequence
  Description of Artificial Sequence: Synthetic oligonucleotide
ggaggcgcuuucccugcua

SEQ ID NO: 10626 - RNA, 19 nt, Artificial Sequence
  Description of Artificial Sequence: Synthetic oligonucleotide
gaggcgcuuucccugcuca

SEQ ID NO: 10627 - RNA, 19 nt, Artificial Sequence
  Description of Artificial Sequence: Synthetic oligonucleotide
aggcgcuuucccugcucca

SEQ ID NO: 10628 - RNA, 19 nt, Artificial Sequence
  Description of Artificial Sequence: Synthetic oligonucleotide
ggcgcuuucccugcuccua

SEQ ID NO: 10629 - RNA, 19 nt, Artificial Sequence
  Description of Artificial Sequence: Synthetic oligonucleotide
gcgcuuucccugcuccuga

SEQ ID NO: 10630 - RNA, 19 nt, Artificial Sequence
  Description of Artificial Sequence: Synthetic oligonucleotide
cgcuuucccugcuccugua

SEQ ID NO: 10631 - RNA, 19 nt, Artificial Sequence
  Description of Artificial Sequence: Synthetic oligonucleotide
gcuuucccugcuccuguua

SEQ ID NO: 10632 - RNA, 19 nt, Artificial Sequence
  Description of Artificial Sequence: Synthetic oligonucleotide
cuuucccugcuccuguuca

SEQ ID NO: 10633 - RNA, 19 nt, Artificial Sequence
  Description of Artificial Sequence: Synthetic oligonucleotide
uuucccugcuccuguucga

SEQ ID NO: 10634 - RNA, 19 nt, Artificial Sequence
  Description of Artificial Sequence: Synthetic oligonucleotide
uucccugcuccuguucgca

SEQ ID NO: 10635 - RNA, 19 nt, Artificial Sequence
  Description of Artificial Sequence: Synthetic oligonucleotide
ucccugcuccuguucgcca

SEQ ID NO: 10636 - RNA, 19 nt, Artificial Sequence
  Description of Artificial Sequence: Synthetic oligonucleotide
cccugcuccuguucgccga

SEQ ID NO: 10637 - RNA, 19 nt, Artificial Sequence
  Description of Artificial Sequence: Synthetic oligonucleotide
ccugcuccuguucgccgua

SEQ ID NO: 10638 - RNA, 19 nt, Artificial Sequence
  Description of Artificial Sequence: Synthetic oligonucleotide
cugcuccuguucgccguua

SEQ ID NO: 10639 - RNA, 19 nt, Artificial Sequence
  Description of Artificial Sequence: Synthetic oligonucleotide
ugcuccuguucgccguuga

SEQ ID NO: 10640 - RNA, 19 nt, Artificial Sequence
  Description of Artificial Sequence: Synthetic oligonucleotide
gcuccuguucgccguugua

SEQ ID NO: 10641 - RNA, 19 nt, Artificial Sequence
  Description of Artificial Sequence: Synthetic oligonucleotide
cuccuguucgccguuguua

SEQ ID NO: 10642 - RNA, 19 nt, Artificial Sequence
  Description of Artificial Sequence: Synthetic oligonucleotide
uccuguucgccguuguuca

SEQ ID NO: 10643 - RNA, 19 nt, Artificial Sequence
  Description of Artificial Sequence: Synthetic oligonucleotide
ccuguucgccguuguucua

SEQ ID NO: 10644 - RNA, 19 nt, Artificial Sequence
  Description of Artificial Sequence: Synthetic oligonucleotide
cuguucgccguuguucuga

SEQ ID NO: 10645 - RNA, 19 nt, Artificial Sequence
  Description of Artificial Sequence: Synthetic oligonucleotide
uguucgccguuguucugua

SEQ ID NO: 10646 - RNA, 19 nt, Artificial Sequence
  Description of Artificial Sequence: Synthetic oligonucleotide
guucgccguuguucuguca

SEQ ID NO: 10647 - RNA, 19 nt, Artificial Sequence
  Description of Artificial Sequence: Synthetic oligonucleotide
uucgccguuguucugucua

SEQ ID NO: 10648 - RNA, 19 nt, Artificial Sequence
  Description of Artificial Sequence: Synthetic oligonucleotide
ucgccguuguucugucuca

SEQ ID NO: 10649 - RNA, 19 nt, Artificial Sequence
  Description of Artificial Sequence: Synthetic oligonucleotide
cgccguuguucugucucga

SEQ ID NO: 10650 - RNA, 19 nt, Artificial Sequence
  Description of Artificial Sequence: Synthetic oligonucleotide
gccguuguucugucucgua

SEQ ID NO: 10651 - RNA, 19 nt, Artificial Sequence
  Description of Artificial Sequence: Synthetic oligonucleotide
ccguuguucugucucguga

SEQ ID NO: 10652 - RNA, 19 nt, Artificial Sequence
  Description of Artificial Sequence: Synthetic oligonucleotide
cguuguucugucucgugca

SEQ ID NO: 10653 - RNA, 19 nt, Artificial Sequence
  Description of Artificial Sequence: Synthetic oligonucleotide
guuguucugucucgugcca

SEQ ID NO: 10654 - RNA, 19 nt, Artificial Sequence
  Description of Artificial Sequence: Synthetic oligonucleotide
uuguucugucucgugccga

SEQ ID NO: 10655 - RNA, 19 nt, Artificial Sequence
  Description of Artificial Sequence: Synthetic oligonucleotide
uguucugucucgugccgca

SEQ ID NO: 10656 - RNA, 19 nt, Artificial Sequence
  Description of Artificial Sequence: Synthetic oligonucleotide
guucugucucgugccgcca

SEQ ID NO: 10657 - RNA, 19 nt, Artificial Sequence
  Description of Artificial Sequence: Synthetic oligonucleotide
uucugucucgugccgccga

SEQ ID NO: 10658 - RNA, 19 nt, Artificial Sequence
  Description of Artificial Sequence: Synthetic oligonucleotide
ucugucucgugccgccgca

SEQ ID NO: 10659 - RNA, 19 nt, Artificial Sequence
  Description of Artificial Sequence: Synthetic oligonucleotide
cugucucgugccgccgcca

SEQ ID NO: 10660 - RNA, 19 nt, Artificial Sequence
  Description of Artificial Sequence: Synthetic oligonucleotide
ugucucgugccgccgccca

SEQ ID NO: 10661 - RNA, 19 nt, Artificial Sequence
  Description of Artificial Sequence: Synthetic oligonucleotide
gucucgugccgccgcccua

SEQ ID NO: 10662 - RNA, 19 nt, Artificial Sequence
  Description of Artificial Sequence: Synthetic oligonucleotide
ucucgugccgccgcccuga

SEQ ID NO: 10663 - RNA, 19 nt, Artificial Sequence
  Description of Artificial Sequence: Synthetic oligonucleotide
cucgugccgccgcccugga

SEQ ID NO: 10664 - RNA, 19 nt, Artificial Sequence
  Description of Artificial Sequence: Synthetic oligonucleotide
ucgugccgccgcccuggga

SEQ ID NO: 10665 - RNA, 19 nt, Artificial Sequence
  Description of Artificial Sequence: Synthetic oligonucleotide
cgugccgccgcccugggca

SEQ ID NO: 10666 - RNA, 19 nt, Artificial Sequence
  Description of Artificial Sequence: Synthetic oligonucleotide
gugccgccgcccugggcua

SEQ ID NO: 10667 - RNA, 19 nt, Artificial Sequence
  Description of Artificial Sequence: Synthetic oligonucleotide
ugccgccgcccugggcuga

SEQ ID NO: 10668 - RNA, 19 nt, Artificial Sequence
  Description of Artificial Sequence: Synthetic oligonucleotide
gccgccgcccugggcugca

SEQ ID NO: 10669 - RNA, 19 nt, Artificial Sequence
  Description of Artificial Sequence: Synthetic oligonucleotide
ccgccgcccugggcugcaa

SEQ ID NO: 10670 - RNA, 19 nt, Artificial Sequence
  Description of Artificial Sequence: Synthetic oligonucleotide
cgccgcccugggcugcaua

SEQ ID NO: 10671 - RNA, 19 nt, Artificial Sequence
  Description of Artificial Sequence: Synthetic oligonucleotide
gccgcccugggcugcauua

SEQ ID NO: 10672 - RNA, 19 nt, Artificial Sequence
  Description of Artificial Sequence: Synthetic oligonucleotide
ccgcccugggcugcauuga

SEQ ID NO: 10673 - RNA, 19 nt, Artificial Sequence
  Description of Artificial Sequence: Synthetic oligonucleotide
cgcccugggcugcauugga

SEQ ID NO: 10674 - RNA, 19 nt, Artificial Sequence
  Description of Artificial Sequence: Synthetic oligonucleotide
gcccugggcugcauuggga

SEQ ID NO: 10675 - RNA, 19 nt, Artificial Sequence
  Description of Artificial Sequence: Synthetic oligonucleotide
cccugggcugcauugggua

SEQ ID NO: 10676 - RNA, 19 nt, Artificial Sequence
  Description of Artificial Sequence: Synthetic oligonucleotide
ccugggcugcauuggguua

SEQ ID NO: 10677 - RNA, 19 nt, Artificial Sequence
  Description of Artificial Sequence: Synthetic oligonucleotide
cugggcugcauuggguuga

SEQ ID NO: 10678 - RNA, 19 nt, Artificial Sequence
  Description of Artificial Sequence: Synthetic oligonucleotide
ugggcugcauuggguugga

SEQ ID NO: 10679 - RNA, 19 nt, Artificial Sequence
  Description of Artificial Sequence: Synthetic oligonucleotide
gggcugcauuggguuggua

SEQ ID NO: 10680 - RNA, 19 nt, Artificial Sequence
  Description of Artificial Sequence: Synthetic oligonucleotide
ggcugcauuggguugguga

SEQ ID NO: 10681 - RNA, 19 nt, Artificial Sequence
  Description of Artificial Sequence: Synthetic oligonucleotide
gcugcauuggguuggugga

SEQ ID NO: 10682 - RNA, 19 nt, Artificial Sequence
  Description of Artificial Sequence: Synthetic oligonucleotide
cugcauuggguugguggca

SEQ ID NO: 10683 - RNA, 19 nt, Artificial Sequence
  Description of Artificial Sequence: Synthetic oligonucleotide
ugcauuggguugguggcca

SEQ ID NO: 10684 - RNA, 19 nt, Artificial Sequence
  Description of Artificial Sequence: Synthetic oligonucleotide
gcauuggguugguggccca

SEQ ID NO: 10685 - RNA, 19 nt, Artificial Sequence
  Description of Artificial Sequence: Synthetic oligonucleotide
cauuggguugguggcccaa

SEQ ID NO: 10686 - RNA, 19 nt, Artificial Sequence
  Description of Artificial Sequence: Synthetic oligonucleotide
auuggguugguggcccaca

SEQ ID NO: 10687 - RNA, 19 nt, Artificial Sequence
  Description of Artificial Sequence: Synthetic oligonucleotide
uuggguugguggcccacga

SEQ ID NO: 10688 - RNA, 19 nt, Artificial Sequence
  Description of Artificial Sequence: Synthetic oligonucleotide
uggguugguggcccacgca

SEQ ID NO: 10689 - RNA, 19 nt, Artificial Sequence
  Description of Artificial Sequence: Synthetic oligonucleotide
ggguugguggcccacgcca

SEQ ID NO: 10690 - RNA, 19 nt, Artificial Sequence
  Description of Artificial Sequence: Synthetic oligonucleotide
gguugguggcccacgccga

SEQ ID NO: 10691 - RNA, 19 nt, Artificial Sequence
  Description of Artificial Sequence: Synthetic oligonucleotide
guugguggcccacgccgga

SEQ ID NO: 10692 - RNA, 19 nt, Artificial Sequence
  Description of Artificial Sequence: Synthetic oligonucleotide
uugguggcccacgccggca

SEQ ID NO: 10693 - RNA, 19 nt, Artificial Sequence
  Description of Artificial Sequence: Synthetic oligonucleotide
ugguggcccacgccggcca

SEQ ID NO: 10694 - RNA, 19 nt, Artificial Sequence
  Description of Artificial Sequence: Synthetic oligonucleotide
gguggcccacgccggccaa

SEQ ID NO: 10695 - RNA, 19 nt, Artificial Sequence
  Description of Artificial Sequence: Synthetic oligonucleotide
guggcccacgccggccaaa

SEQ ID NO: 10696 - RNA, 19 nt, Artificial Sequence
  Description of Artificial Sequence: Synthetic oligonucleotide
uggcccacgccggccaaca

SEQ ID NO: 10697 - RNA, 19 nt, Artificial Sequence
  Description of Artificial Sequence: Synthetic oligonucleotide
ggcccacgccggccaacua

SEQ ID NO: 10698 - RNA, 19 nt, Artificial Sequence
  Description of Artificial Sequence: Synthetic oligonucleotide
gcccacgccggccaacuca

SEQ ID NO: 10699 - RNA, 19 nt, Artificial Sequence
  Description of Artificial Sequence: Synthetic oligonucleotide
cccacgccggccaacucaa

SEQ ID NO: 10700 - RNA, 19 nt, Artificial Sequence
  Description of Artificial Sequence: Synthetic oligonucleotide
ccacgccggccaacucaca

SEQ ID NO: 10701 - RNA, 19 nt, Artificial Sequence
  Description of Artificial Sequence: Synthetic oligonucleotide
cacgccggccaacucacca

SEQ ID NO: 10702 - RNA, 19 nt, Artificial Sequence
  Description of Artificial Sequence: Synthetic oligonucleotide
acgccggccaacucaccga

SEQ ID NO: 10703 - RNA, 19 nt, Artificial Sequence
  Description of Artificial Sequence: Synthetic oligonucleotide
cgccggccaacucaccgca

SEQ ID NO: 10704 - RNA, 19 nt, Artificial Sequence
  Description of Artificial Sequence: Synthetic oligonucleotide
gccggccaacucaccgcaa

SEQ ID NO: 10705 - RNA, 19 nt, Artificial Sequence
  Description of Artificial Sequence: Synthetic oligonucleotide
ccggccaacucaccgcaga

SEQ ID NO: 10706 - RNA, 19 nt, Artificial Sequence
  Description of Artificial Sequence: Synthetic oligonucleotide
cggccaacucaccgcagua

SEQ ID NO: 10707 - RNA, 19 nt, Artificial Sequence
  Description of Artificial Sequence: Synthetic oligonucleotide
ggccaacucaccgcaguca

SEQ ID NO: 10708 - RNA, 19 nt, Artificial Sequence
  Description of Artificial Sequence: Synthetic oligonucleotide
gccaacucaccgcagucua

SEQ ID NO: 10709 - RNA, 19 nt, Artificial Sequence
  Description of Artificial Sequence: Synthetic oligonucleotide
ccaacucaccgcagucuga

SEQ ID NO: 10710 - RNA, 19 nt, Artificial Sequence
  Description of Artificial Sequence: Synthetic oligonucleotide
caacucaccgcagucugga

SEQ ID NO: 10711 - RNA, 19 nt, Artificial Sequence
  Description of Artificial Sequence: Synthetic oligonucleotide
aacucaccgcagucuggca

SEQ ID NO: 10712 - RNA, 19 nt, Artificial Sequence
  Description of Artificial Sequence: Synthetic oligonucleotide
acucaccgcagucuggcga

SEQ ID NO: 10713 - RNA, 19 nt, Artificial Sequence
  Description of Artificial Sequence: Synthetic oligonucleotide
cucaccgcagucuggcgca

SEQ ID NO: 10714 - RNA, 19 nt, Artificial Sequence
  Description of Artificial Sequence: Synthetic oligonucleotide
ucaccgcagucuggcgcca

SEQ ID NO: 10715 - RNA, 19 nt, Artificial Sequence
  Description of Artificial Sequence: Synthetic oligonucleotide
caccgcagucuggcgccga

SEQ ID NO: 10716 - RNA, 19 nt, Artificial Sequence
  Description of Artificial Sequence: Synthetic oligonucleotide
accgcagucuggcgccgca

SEQ ID NO: 10717 - RNA, 19 nt, Artificial Sequence
  Description of Artificial Sequence: Synthetic oligonucleotide
ccgcagucuggcgccgcca

SEQ ID NO: 10718 - RNA, 19 nt, Artificial Sequence
  Description of Artificial Sequence: Synthetic oligonucleotide
cgcagucuggcgccgccca

SEQ ID NO: 10719 - RNA, 19 nt, Artificial Sequence
  Description of Artificial Sequence: Synthetic oligonucleotide
gcagucuggcgccgcccaa

SEQ ID NO: 10720 - RNA, 19 nt, Artificial Sequence
  Description of Artificial Sequence: Synthetic oligonucleotide
cagucuggcgccgcccaga

SEQ ID NO: 10721 - RNA, 19 nt, Artificial Sequence
  Description of Artificial Sequence: Synthetic oligonucleotide
agucuggcgccgcccagga

SEQ ID NO: 10722 - RNA, 19 nt, Artificial Sequence
  Description of Artificial Sequence: Synthetic oligonucleotide
gucuggcgccgcccaggaa

SEQ ID NO: 10723 - RNA, 19 nt, Artificial Sequence
  Description of Artificial Sequence: Synthetic oligonucleotide
ucuggcgccgcccaggaga

SEQ ID NO: 10724 - RNA, 19 nt, Artificial Sequence
  Description of Artificial Sequence: Synthetic oligonucleotide
cuggcgccgcccaggagca

SEQ ID NO: 10725 - RNA, 19 nt, Artificial Sequence
  Description of Artificial Sequence: Synthetic oligonucleotide
uggcgccgcccaggagcca

SEQ ID NO: 10726 - RNA, 19 nt, Artificial Sequence
  Description of Artificial Sequence: Synthetic oligonucleotide
ggcgccgcccaggagccga

SEQ ID NO: 10727 - RNA, 19 nt, Artificial Sequence
  Description of Artificial Sequence: Synthetic oligonucleotide
gcgccgcccaggagccgca

SEQ ID NO: 10728 - RNA, 19 nt, Artificial Sequence
  Description of Artificial Sequence: Synthetic oligonucleotide
cgccgcccaggagccgcca

SEQ ID NO: 10729 - RNA, 19 nt, Artificial Sequence
  Description of Artificial Sequence: Synthetic oligonucleotide
gccgcccaggagccgccca

SEQ ID NO: 10730 - RNA, 19 nt, Artificial Sequence
  Description of Artificial Sequence: Synthetic oligonucleotide
ccgcccaggagccgcccga

SEQ ID NO: 10731 - RNA, 19 nt, Artificial Sequence
  Description of Artificial Sequence: Synthetic oligonucleotide
cgcccaggagccgcccgca

SEQ ID NO: 10732 - RNA, 19 nt, Artificial Sequence
  Description of Artificial Sequence: Synthetic oligonucleotide
gcccaggagccgcccgcga

SEQ ID NO: 10733 - RNA, 19 nt, Artificial Sequence
  Description of Artificial Sequence: Synthetic oligonucleotide
cccaggagccgcccgcgca

SEQ ID NO: 10734 - RNA, 19 nt, Artificial Sequence
  Description of Artificial Sequence: Synthetic oligonucleotide
ccaggagccgcccgcgcua

SEQ ID NO: 10735 - RNA, 19 nt, Artificial Sequence
  Description of Artificial Sequence: Synthetic oligonucleotide
caggagccgcccgcgcuca

SEQ ID NO: 10736 - RNA, 19 nt, Artificial Sequence
  Description of Artificial Sequence: Synthetic oligonucleotide
aggagccgcccgcgcucca

SEQ ID NO: 10737 - RNA, 19 nt, Artificial Sequence
  Description of Artificial Sequence: Synthetic oligonucleotide
ggagccgcccgcgcuccca

SEQ ID NO: 10738 - RNA, 19 nt, Artificial Sequence
  Description of Artificial Sequence: Synthetic oligonucleotide
gagccgcccgcgcucccua

SEQ ID NO: 10739 - RNA, 19 nt, Artificial Sequence
  Description of Artificial Sequence: Synthetic oligonucleotide
agccgcccgcgcucccuga

SEQ ID NO: 10740 - RNA, 19 nt, Artificial Sequence
  Description of Artificial Sequence: Synthetic oligonucleotide
gccgcccgcgcucccugaa

SEQ ID NO: 10741 - RNA, 19 nt, Artificial Sequence
  Description of Artificial Sequence: Synthetic oligonucleotide
ccgcccgcgcucccugaaa

SEQ ID NO: 10742 - RNA, 19 nt, Artificial Sequence
  Description of Artificial Sequence: Synthetic oligonucleotide
cgcccgcgcucccugaaca

SEQ ID NO: 10743 - RNA, 19 nt, Artificial Sequence
  Description of Artificial Sequence: Synthetic oligonucleotide
gcccgcgcucccugaacca

SEQ ID NO: 10744 - RNA, 19 nt, Artificial Sequence
  Description of Artificial Sequence: Synthetic oligonucleotide
cccgcgcucccugaaccca

SEQ ID NO: 10745 - RNA, 19 nt, Artificial Sequence
  Description of Artificial Sequence: Synthetic oligonucleotide
ccgcgcucccugaacccua

SEQ ID NO: 10746 - RNA, 19 nt, Artificial Sequence
  Description of Artificial Sequence: Synthetic oligonucleotide
cgcgcucccugaacccuaa

SEQ ID NO: 10747 - RNA, 19 nt, Artificial Sequence
  Description of Artificial Sequence: Synthetic oligonucleotide
gcgcucccugaacccuaga

SEQ ID NO: 10748 - RNA, 19 nt, Artificial Sequence
  Description of Artificial Sequence: Synthetic oligonucleotide
cgcucccugaacccuagaa

SEQ ID NO: 10749 - RNA, 19 nt, Artificial Sequence
  Description of Artificial Sequence: Synthetic oligonucleotide
gcucccugaacccuagaaa

SEQ ID NO: 10750 - RNA, 19 nt, Artificial Sequence
  Description of Artificial Sequence: Synthetic oligonucleotide
cucccugaacccuagaaca

SEQ ID NO: 10751 - RNA, 19 nt, Artificial Sequence
  Description of Artificial Sequence: Synthetic oligonucleotide
ucccugaacccuagaacua

SEQ ID NO: 10752 - RNA, 19 nt, Artificial Sequence
  Description of Artificial Sequence: Synthetic oligonucleotide
cccugaacccuagaacuga

SEQ ID NO: 10753 - RNA, 19 nt, Artificial Sequence
  Description of Artificial Sequence: Synthetic oligonucleotide
ccugaacccuagaacugua

SEQ ID NO: 10754 - RNA, 19 nt, Artificial Sequence
  Description of Artificial Sequence: Synthetic oligonucleotide
cugaacccuagaacuguca

SEQ ID NO: 10755 - RNA, 19 nt, Artificial Sequence
  Description of Artificial Sequence: Synthetic oligonucleotide
ugaacccuagaacugucua

SEQ ID NO: 10756 - RNA, 19 nt, Artificial Sequence
  Description of Artificial Sequence: Synthetic oligonucleotide
gaacccuagaacugucuua

SEQ ID NO: 10757 - RNA, 19 nt, Artificial Sequence
  Description of Artificial Sequence: Synthetic oligonucleotide
aacccuagaacugucuuca

SEQ ID NO: 10758 - RNA, 19 nt, Artificial Sequence
  Description of Artificial Sequence: Synthetic oligonucleotide
acccuagaacugucuucga

SEQ ID NO: 10759 - RNA, 19 nt, Artificial Sequence
  Description of Artificial Sequence: Synthetic oligonucleotide
cccuagaacugucuucgaa

SEQ ID NO: 10760 - RNA, 19 nt, Artificial Sequence
  Description of Artificial Sequence: Synthetic oligonucleotide
ccuagaacugucuucgaca

SEQ ID NO: 10761 - RNA, 19 nt, Artificial Sequence
  Description of Artificial Sequence: Synthetic oligonucleotide
cuagaacugucuucgacua

SEQ ID NO: 10762 - RNA, 19 nt, Artificial Sequence
  Description of Artificial Sequence: Synthetic oligonucleotide
uagaacugucuucgacuca

SEQ ID NO: 10763 - RNA, 19 nt, Artificial Sequence
  Description of Artificial Sequence: Synthetic oligonucleotide
agaacugucuucgacucca

SEQ ID NO: 10764 - RNA, 19 nt, Artificial Sequence
  Description of Artificial Sequence: Synthetic oligonucleotide
gaacugucuucgacuccga

SEQ ID NO: 10765 - RNA, 19 nt, Artificial Sequence
  Description of Artificial Sequence: Synthetic oligonucleotide
aacugucuucgacuccgga

SEQ ID NO: 10766 - RNA, 19 nt, Artificial Sequence
  Description of Artificial Sequence: Synthetic oligonucleotide
acugucuucgacuccggga

SEQ ID NO: 10767 - RNA, 19 nt, Artificial Sequence
  Description of Artificial Sequence: Synthetic oligonucleotide
cugucuucgacuccgggga

SEQ ID NO: 10768 - RNA, 19 nt, Artificial Sequence
  Description of Artificial Sequence: Synthetic oligonucleotide
ugucuucgacuccggggca

SEQ ID NO: 10769 - RNA, 19 nt, Artificial Sequence
  Description of Artificial Sequence: Synthetic oligonucleotide
gucuucgacuccggggcca

SEQ ID NO: 10770 - RNA, 19 nt, Artificial Sequence
  Description of Artificial Sequence: Synthetic oligonucleotide
ucuucgacuccggggccca

SEQ ID NO: 10771 - RNA, 19 nt, Artificial Sequence
  Description of Artificial Sequence: Synthetic oligonucleotide
cuucgacuccggggcccca

SEQ ID NO: 10772 - RNA, 19 nt, Artificial Sequence
  Description of Artificial Sequence: Synthetic oligonucleotide
uucgacuccggggccccga

SEQ ID NO: 10773 - RNA, 19 nt, Artificial Sequence
  Description of Artificial Sequence: Synthetic oligonucleotide
ucgacuccggggccccgua

SEQ ID NO: 10774 - RNA, 19 nt, Artificial Sequence
  Description of Artificial Sequence: Synthetic oligonucleotide
cgacuccggggccccguua

SEQ ID NO: 10775 - RNA, 19 nt, Artificial Sequence
  Description of Artificial Sequence: Synthetic oligonucleotide
gacuccggggccccguuga

SEQ ID NO: 10776 - RNA, 19 nt, Artificial Sequence
  Description of Artificial Sequence: Synthetic oligonucleotide
acuccggggccccguugga

SEQ ID NO: 10777 - RNA, 19 nt, Artificial Sequence
  Description of Artificial Sequence: Synthetic oligonucleotide
cuccggggccccguuggaa

SEQ ID NO: 10778 - RNA, 19 nt, Artificial Sequence
  Description of Artificial Sequence: Synthetic oligonucleotide
uccggggccccguuggaaa

SEQ ID NO: 10779 - RNA, 19 nt, Artificial Sequence
  Description of Artificial Sequence: Synthetic oligonucleotide
ccggggccccguuggaaga

SEQ ID NO: 10780 - RNA, 19 nt, Artificial Sequence
  Description of Artificial Sequence: Synthetic oligonucleotide
cggggccccguuggaagaa

SEQ ID NO: 10781 - RNA, 19 nt, Artificial Sequence
  Description of Artificial Sequence: Synthetic oligonucleotide
ggggccccguuggaagaca

SEQ ID NO: 10782 - RNA, 19 nt, Artificial Sequence
  Description of Artificial Sequence: Synthetic oligonucleotide
gggccccguuggaagacua

SEQ ID NO: 10783 - RNA, 19 nt, Artificial Sequence
  Description of Artificial Sequence: Synthetic oligonucleotide
ggccccguuggaagacuga

SEQ ID NO: 10784 - RNA, 19 nt, Artificial Sequence
  Description of Artificial Sequence: Synthetic oligonucleotide
gccccguuggaagacugaa

SEQ ID NO: 10785 - RNA, 19 nt, Artificial Sequence
  Description of Artificial Sequence: Synthetic oligonucleotide
ccccguuggaagacugaga

SEQ ID NO: 10786 - RNA, 19 nt, Artificial Sequence
  Description of Artificial Sequence: Synthetic oligonucleotide
cccguuggaagacugagua

SEQ ID NO: 10787 - RNA, 19 nt, Artificial Sequence
  Description of Artificial Sequence: Synthetic oligonucleotide
ccguuggaagacugaguga

SEQ ID NO: 10788 - RNA, 19 nt, Artificial Sequence
  Description of Artificial Sequence: Synthetic oligonucleotide
cguuggaagacugagugca

SEQ ID NO: 10789 - RNA, 19 nt, Artificial Sequence
  Description of Artificial Sequence: Synthetic oligonucleotide
guuggaagacugagugcca

SEQ ID NO: 10790 - RNA, 19 nt, Artificial Sequence
  Description of Artificial Sequence: Synthetic oligonucleotide
uuggaagacugagugccca

SEQ ID NO: 10791 - RNA, 19 nt, Artificial Sequence
  Description of Artificial Sequence: Synthetic oligonucleotide
uggaagacugagugcccga

SEQ ID NO: 10792 - RNA, 19 nt, Artificial Sequence
  Description of Artificial Sequence: Synthetic oligonucleotide
ggaagacugagugcccgga

SEQ ID NO: 10793 - RNA, 19 nt, Artificial Sequence
  Description of Artificial Sequence: Synthetic oligonucleotide
gaagacugagugcccggga

SEQ ID NO: 10794 - RNA, 19 nt, Artificial Sequence
  Description of Artificial Sequence: Synthetic oligonucleotide
aagacugagugcccgggga

SEQ ID NO: 10795 - RNA, 19 nt, Artificial Sequence
  Description of Artificial Sequence: Synthetic oligonucleotide
agacugagugcccggggca

SEQ ID NO: 10796 - RNA, 19 nt, Artificial Sequence
  Description of Artificial Sequence: Synthetic oligonucleotide
gacugagugcccggggcaa

SEQ ID NO: 10797 - RNA, 19 nt, Artificial Sequence
  Description of Artificial Sequence: Synthetic oligonucleotide
acugagugcccggggcaca

SEQ ID NO: 10798 - RNA, 19 nt, Artificial Sequence
  Description of Artificial Sequence: Synthetic oligonucleotide
cugagugcccggggcacga

SEQ ID NO: 10799 - RNA, 19 nt, Artificial Sequence
  Description of Artificial Sequence: Synthetic oligonucleotide
ugagugcccggggcacgga

SEQ ID NO: 10800 - RNA, 19 nt, Artificial Sequence
  Description of Artificial Sequence: Synthetic oligonucleotide
gagugcccggggcacggca

SEQ ID NO: 10801 - RNA, 19 nt, Artificial Sequence
  Description of Artificial Sequence: Synthetic oligonucleotide
agugcccggggcacggcaa

SEQ ID NO: 10802 - RNA, 19 nt, Artificial Sequence
  Description of Artificial Sequence: Synthetic oligonucleotide
gugcccggggcacggcaca

SEQ ID NO: 10803 - RNA, 19 nt, Artificial Sequence
  Description of Artificial Sequence: Synthetic oligonucleotide
ugcccggggcacggcacaa

SEQ ID NO: 10804 - RNA, 19 nt, Artificial Sequence
  Description of Artificial Sequence: Synthetic oligonucleotide
gcccggggcacggcacaga

SEQ ID NO: 10805 - RNA, 19 nt, Artificial Sequence
  Description of Artificial Sequence: Synthetic oligonucleotide
cccggggcacggcacagaa

SEQ ID NO: 10806 - RNA, 19 nt, Artificial Sequence
  Description of Artificial Sequence: Synthetic oligonucleotide
ccggggcacggcacagaaa

SEQ ID NO: 10807 - RNA, 19 nt, Artificial Sequence
  Description of Artificial Sequence: Synthetic oligonucleotide
cggggcacggcacagaaga

SEQ ID NO: 10808 - RNA, 19 nt, Artificial Sequence
  Description of Artificial Sequence: Synthetic oligonucleotide
ggggcacggcacagaagca

SEQ ID NO: 10809 - RNA, 19 nt, Artificial Sequence
  Description of Artificial Sequence: Synthetic oligonucleotide
gggcacggcacagaagcca

SEQ ID NO: 10810 - RNA, 19 nt, Artificial Sequence
  Description of Artificial Sequence: Synthetic oligonucleotide
ggcacggcacagaagccga

SEQ ID NO: 10811 - RNA, 19 nt, Artificial Sequence
  Description of Artificial Sequence: Synthetic oligonucleotide
gcacggcacagaagccgca

SEQ ID NO: 10812 - RNA, 19 nt, Artificial Sequence
  Description of Artificial Sequence: Synthetic oligonucleotide
cacggcacagaagccgcga

SEQ ID NO: 10813 - RNA, 19 nt, Artificial Sequence
  Description of Artificial Sequence: Synthetic oligonucleotide
acggcacagaagccgcgca

SEQ ID NO: 10814 - RNA, 19 nt, Artificial Sequence
  Description of Artificial Sequence: Synthetic oligonucleotide
cggcacagaagccgcgcca

SEQ ID NO: 10815 - RNA, 19 nt, Artificial Sequence
  Description of Artificial Sequence: Synthetic oligonucleotide
ggcacagaagccgcgccca

SEQ ID NO: 10816 - RNA, 19 nt, Artificial Sequence
  Description of Artificial Sequence: Synthetic oligonucleotide
gcacagaagccgcgcccaa

SEQ ID NO: 10817 - RNA, 19 nt, Artificial Sequence
  Description of Artificial Sequence: Synthetic oligonucleotide
cacagaagccgcgcccaca

SEQ ID NO: 10818 - RNA, 19 nt, Artificial Sequence
  Description of Artificial Sequence: Synthetic oligonucleotide
acagaagccgcgcccacca

SEQ ID NO: 10819 - RNA, 19 nt, Artificial Sequence
  Description of Artificial Sequence: Synthetic oligonucleotide
cagaagccgcgcccaccga

SEQ ID NO: 10820 - RNA, 19 nt, Artificial Sequence
  Description of Artificial Sequence: Synthetic oligonucleotide
agaagccgcgcccaccgca

SEQ ID NO: 10821 - RNA, 19 nt, Artificial Sequence
  Description of Artificial Sequence: Synthetic oligonucleotide
gaagccgcgcccaccgcca

SEQ ID NO: 10822 - RNA, 19 nt, Artificial Sequence
  Description of Artificial Sequence: Synthetic oligonucleotide
aagccgcgcccaccgccua

SEQ ID NO: 10823 - RNA, 19 nt, Artificial Sequence
  Description of Artificial Sequence: Synthetic oligonucleotide
agccgcgcccaccgccuga

SEQ ID NO: 10824 - RNA, 19 nt, Artificial Sequence
  Description of Artificial Sequence: Synthetic oligonucleotide
gccgcgcccaccgccugca

SEQ ID NO: 10825 - RNA, 19 nt, Artificial Sequence
  Description of Artificial Sequence: Synthetic oligonucleotide
ccgcgcccaccgccugcca

SEQ ID NO: 10826 - RNA, 19 nt, Artificial Sequence
  Description of Artificial Sequence: Synthetic oligonucleotide
cgcgcccaccgccugccaa

SEQ ID NO: 10827 - RNA, 19 nt, Artificial Sequence
  Description of Artificial Sequence: Synthetic oligonucleotide
gcgcccaccgccugccaga

SEQ ID NO: 10828 - RNA, 19 nt, Artificial Sequence
  Description of Artificial Sequence: Synthetic oligonucleotide
cgcccaccgccugccagua

SEQ ID NO: 10829 - RNA, 19 nt, Artificial Sequence
  Description of Artificial Sequence: Synthetic oligonucleotide
gcccaccgccugccaguua

SEQ ID NO: 10830 - RNA, 19 nt, Artificial Sequence
  Description of Artificial Sequence: Synthetic oligonucleotide
cccaccgccugccaguuca

SEQ ID NO: 10831 - RNA, 19 nt, Artificial Sequence
  Description of Artificial Sequence: Synthetic oligonucleotide
ccaccgccugccaguucaa

SEQ ID NO: 10832 - RNA, 19 nt, Artificial Sequence
  Description of Artificial Sequence: Synthetic oligonucleotide
caccgccugccaguucaca

SEQ ID NO: 10833 - RNA, 19 nt, Artificial Sequence
  Description of Artificial Sequence: Synthetic oligonucleotide
accgccugccaguucacaa

SEQ ID NO: 10834 - RNA, 19 nt, Artificial Sequence
  Description of Artificial Sequence: Synthetic oligonucleotide
ccgccugccaguucacaaa

SEQ ID NO: 10835 - RNA, 19 nt, Artificial Sequence
  Description of Artificial Sequence: Synthetic oligonucleotide
cgccugccaguucacaaca

SEQ ID NO: 10836 - RNA, 19 nt, Artificial Sequence
  Description of Artificial Sequence: Synthetic oligonucleotide
gccugccaguucacaacca

SEQ ID NO: 10837 - RNA, 19 nt, Artificial Sequence
  Description of Artificial Sequence: Synthetic oligonucleotide
ccugccaguucacaaccga

SEQ ID NO: 10838 - RNA, 19 nt, Artificial Sequence
  Description of Artificial Sequence: Synthetic oligonucleotide
cugccaguucacaaccgca

SEQ ID NO: 10839 - RNA, 19 nt, Artificial Sequence
  Description of Artificial Sequence: Synthetic oligonucleotide
ugccaguucacaaccgcua

SEQ ID NO: 10840 - RNA, 19 nt, Artificial Sequence
  Description of Artificial Sequence: Synthetic oligonucleotide
gccaguucacaaccgcuca

SEQ ID NO: 10841 - RNA, 19 nt, Artificial Sequence
  Description of Artificial Sequence: Synthetic oligonucleotide
ccaguucacaaccgcucca

SEQ ID NO: 10842 - RNA, 19 nt, Artificial Sequence
  Description of Artificial Sequence: Synthetic oligonucleotide
caguucacaaccgcuccga

SEQ ID NO: 10843 - RNA, 19 nt, Artificial Sequence
  Description of Artificial Sequence: Synthetic oligonucleotide
aguucacaaccgcuccgaa

SEQ ID NO: 10844 - RNA, 19 nt, Artificial Sequence
  Description of Artificial Sequence: Synthetic oligonucleotide
guucacaaccgcuccgaga

SEQ ID NO: 10845 - RNA, 19 nt, Artificial Sequence
  Description of Artificial Sequence: Synthetic oligonucleotide
uucacaaccgcuccgagca

SEQ ID NO: 10846 - RNA, 19 nt, Artificial Sequence
  Description of Artificial Sequence: Synthetic oligonucleotide
ucacaaccgcuccgagcga

SEQ ID NO: 10847 - RNA, 19 nt, Artificial Sequence
  Description of Artificial Sequence: Synthetic oligonucleotide
cacaaccgcuccgagcgua

SEQ ID NO: 10848 - RNA, 19 nt, Artificial Sequence
  Description of Artificial Sequence: Synthetic oligonucleotide
acaaccgcuccgagcguga

SEQ ID NO: 10849 - RNA, 19 nt, Artificial Sequence
  Description of Artificial Sequence: Synthetic oligonucleotide
caaccgcuccgagcgugga

SEQ ID NO: 10850 - RNA, 19 nt, Artificial Sequence
  Description of Artificial Sequence: Synthetic oligonucleotide
aaccgcuccgagcguggga

SEQ ID NO: 10851 - RNA, 19 nt, Artificial Sequence
  Description of Artificial Sequence: Synthetic oligonucleotide
accgcuccgagcgugggua

SEQ ID NO: 10852 - RNA, 19 nt, Artificial Sequence
  Description of Artificial Sequence: Synthetic oligonucleotide
ccgcuccgagcguggguca

SEQ ID NO: 10853 - RNA, 19 nt, Artificial Sequence
  Description of Artificial Sequence: Synthetic oligonucleotide
cgcuccgagcgugggucua

SEQ ID NO: 10854 - RNA, 19 nt, Artificial Sequence
  Description of Artificial Sequence: Synthetic oligonucleotide
gcuccgagcgugggucuca

SEQ ID NO: 10855 - RNA, 19 nt, Artificial Sequence
  Description of Artificial Sequence: Synthetic oligonucleotide
cuccgagcgugggucucca

SEQ ID NO: 10856 - RNA, 19 nt, Artificial Sequence
  Description of Artificial Sequence: Synthetic oligonucleotide
uccgagcgugggucuccga

SEQ ID NO: 10857 - RNA, 19 nt, Artificial Sequence
  Description of Artificial Sequence: Synthetic oligonucleotide
ccgagcgugggucuccgca

SEQ ID NO: 10858 - RNA, 19 nt, Artificial Sequence
  Description of Artificial Sequence: Synthetic oligonucleotide
cgagcgugggucuccgcca

SEQ ID NO: 10859 - RNA, 19 nt, Artificial Sequence
  Description of Artificial Sequence: Synthetic oligonucleotide
gagcgugggucuccgccca

SEQ ID NO: 10860 - RNA, 19 nt, Artificial Sequence
  Description of Artificial Sequence: Synthetic oligonucleotide
agcgugggucuccgcccaa

SEQ ID NO: 10861 - RNA, 19 nt, Artificial Sequence
  Description of Artificial Sequence: Synthetic oligonucleotide
gcgugggucuccgcccaga

SEQ ID NO: 10862 - RNA, 19 nt, Artificial Sequence
  Description of Artificial Sequence: Synthetic oligonucleotide
cgugggucuccgcccagca

SEQ ID NO: 10863 - RNA, 19 nt, Artificial Sequence
  Description of Artificial Sequence: Synthetic oligonucleotide
gugggucuccgcccagcua

SEQ ID NO: 10864 - RNA, 19 nt, Artificial Sequence
  Description of Artificial Sequence: Synthetic oligonucleotide
ugggucuccgcccagcuca

SEQ ID NO: 10865 - RNA, 19 nt, Artificial Sequence
  Description of Artificial Sequence: Synthetic oligonucleotide
gggucuccgcccagcucca

SEQ ID NO: 10866 - RNA, 19 nt, Artificial Sequence
  Description of Artificial Sequence: Synthetic oligonucleotide
ggucuccgcccagcuccaa

SEQ ID NO: 10867 - RNA, 19 nt, Artificial Sequence
  Description of Artificial Sequence: Synthetic oligonucleotide
gucuccgcccagcuccaga

SEQ ID NO: 10868 - RNA, 19 nt, Artificial Sequence
  Description of Artificial Sequence: Synthetic oligonucleotide
ucuccgcccagcuccagua

SEQ ID NO: 10869 - RNA, 19 nt, Artificial Sequence
  Description of Artificial Sequence: Synthetic oligonucleotide
cuccgcccagcuccaguca

SEQ ID NO: 10870 - RNA, 19 nt, Artificial Sequence
  Description of Artificial Sequence: Synthetic oligonucleotide
uccgcccagcuccagucca

SEQ ID NO: 10871 - RNA, 19 nt, Artificial Sequence
  Description of Artificial Sequence: Synthetic oligonucleotide
ccgcccagcuccaguccua

SEQ ID NO: 10872 - RNA, 19 nt, Artificial Sequence
  Description of Artificial Sequence: Synthetic oligonucleotide
cgcccagcuccaguccuga

SEQ ID NO: 10873 - RNA, 19 nt, Artificial Sequence
  Description of Artificial Sequence: Synthetic oligonucleotide
gcccagcuccaguccugua

SEQ ID NO: 10874 - RNA, 19 nt, Artificial Sequence
  Description of Artificial Sequence: Synthetic oligonucleotide
cccagcuccaguccuguga

SEQ ID NO: 10875 - RNA, 19 nt, Artificial Sequence
  Description of Artificial Sequence: Synthetic oligonucleotide
ccagcuccaguccugugaa

SEQ ID NO: 10876 - RNA, 19 nt, Artificial Sequence
  Description of Artificial Sequence: Synthetic oligonucleotide
cagcuccaguccugugaua

SEQ ID NO: 10877 - RNA, 19 nt, Artificial Sequence
  Description of Artificial Sequence: Synthetic oligonucleotide
agcuccaguccugugauca

SEQ ID NO: 10878 - RNA, 19 nt, Artificial Sequence
  Description of Artificial Sequence: Synthetic oligonucleotide
gcuccaguccugugaucca

SEQ ID NO: 10879 - RNA, 19 nt, Artificial Sequence
  Description of Artificial Sequence: Synthetic oligonucleotide
cuccaguccugugauccga

SEQ ID NO: 10880 - RNA, 19 nt, Artificial Sequence
  Description of Artificial Sequence: Synthetic oligonucleotide
uccaguccugugauccgga

SEQ ID NO: 10881 - RNA, 19 nt, Artificial Sequence
  Description of Artificial Sequence: Synthetic oligonucleotide
ccaguccugugauccggga

SEQ ID NO: 10882 - RNA, 19 nt, Artificial Sequence
  Description of Artificial Sequence: Synthetic oligonucleotide
caguccugugauccgggca

SEQ ID NO: 10883 - RNA, 19 nt, Artificial Sequence
  Description of Artificial Sequence: Synthetic oligonucleotide
aguccugugauccgggcca

SEQ ID NO: 10884 - RNA, 19 nt, Artificial Sequence
  Description of Artificial Sequence: Synthetic oligonucleotide
guccugugauccgggccca

SEQ ID NO: 10885 - RNA, 19 nt, Artificial Sequence
  Description of Artificial Sequence: Synthetic oligonucleotide
uccugugauccgggcccga

SEQ ID NO: 10886 - RNA, 19 nt, Artificial Sequence
  Description of Artificial Sequence: Synthetic oligonucleotide
ccugugauccgggcccgca

SEQ ID NO: 10887 - RNA, 19 nt, Artificial Sequence
  Description of Artificial Sequence: Synthetic oligonucleotide
cugugauccgggcccgcca

SEQ ID NO: 10888 - RNA, 19 nt, Artificial Sequence
  Description of Artificial Sequence: Synthetic oligonucleotide
ugugauccgggcccgccca

SEQ ID NO: 10889 - RNA, 19 nt, Artificial Sequence
  Description of Artificial Sequence: Synthetic oligonucleotide
gugauccgggcccgcccca

SEQ ID NO: 10890 - RNA, 19 nt, Artificial Sequence
  Description of Artificial Sequence: Synthetic oligonucleotide
ugauccgggcccgccccca

SEQ ID NO: 10891 - RNA, 19 nt, Artificial Sequence
  Description of Artificial Sequence: Synthetic oligonucleotide
gauccgggcccgcccccua

SEQ ID NO: 10892 - RNA, 19 nt, Artificial Sequence
  Description of Artificial Sequence: Synthetic oligonucleotide
auccgggcccgcccccuaa

SEQ ID NO: 10893 - RNA, 19 nt, Artificial Sequence
  Description of Artificial Sequence: Synthetic oligonucleotide
uccgggcccgcccccuaga

SEQ ID NO: 10894 - RNA, 19 nt, Artificial Sequence
  Description of Artificial Sequence: Synthetic oligonucleotide
ccgggcccgcccccuagca

SEQ ID NO: 10895 - RNA, 19 nt, Artificial Sequence
  Description of Artificial Sequence: Synthetic oligonucleotide
cgggcccgcccccuagcga

SEQ ID NO: 10896 - RNA, 19 nt, Artificial Sequence
  Description of Artificial Sequence: Synthetic oligonucleotide
gggcccgcccccuagcgga

SEQ ID NO: 10897 - RNA, 19 nt, Artificial Sequence
  Description of Artificial Sequence: Synthetic oligonucleotide
ggcccgcccccuagcggca

SEQ ID NO: 10898 - RNA, 19 nt, Artificial Sequence
  Description of Artificial Sequence: Synthetic oligonucleotide
gcccgcccccuagcggcca

SEQ ID NO: 10899 - RNA, 19 nt, Artificial Sequence
  Description of Artificial Sequence: Synthetic oligonucleotide
cccgcccccuagcggccga

SEQ ID NO: 10900 - RNA, 19 nt, Artificial Sequence
  Description of Artificial Sequence: Synthetic oligonucleotide
ccgcccccuagcggccgga

SEQ ID NO: 10901 - RNA, 19 nt, Artificial Sequence
  Description of Artificial Sequence: Synthetic oligonucleotide
cgcccccuagcggccggga

SEQ ID NO: 10902 - RNA, 19 nt, Artificial Sequence
  Description of Artificial Sequence: Synthetic oligonucleotide
gcccccuagcggccgggga

SEQ ID NO: 10903 - RNA, 19 nt, Artificial Sequence
  Description of Artificial Sequence: Synthetic oligonucleotide
cccccuagcggccggggaa

SEQ ID NO: 10904 - RNA, 19 nt, Artificial Sequence
  Description of Artificial Sequence: Synthetic oligonucleotide
ccccuagcggccggggaga

SEQ ID NO: 10905 - RNA, 19 nt, Artificial Sequence
  Description of Artificial Sequence: Synthetic oligonucleotide
cccuagcggccggggagga

SEQ ID NO: 10906 - RNA, 19 nt, Artificial Sequence
  Description of Artificial Sequence: Synthetic oligonucleotide
ccuagcggccggggaggga

SEQ ID NO: 10907 - RNA, 19 nt, Artificial Sequence
  Description of Artificial Sequence: Synthetic oligonucleotide
cuagcggccggggagggaa

SEQ ID NO: 10908 - RNA, 19 nt, Artificial Sequence
  Description of Artificial Sequence: Synthetic oligonucleotide
uagcggccggggagggaga

SEQ ID NO: 10909 - RNA, 19 nt, Artificial Sequence
  Description of Artificial Sequence: Synthetic oligonucleotide
agcggccggggagggagga

SEQ ID NO: 10910 - RNA, 19 nt, Artificial Sequence
  Description of Artificial Sequence: Synthetic oligonucleotide
gcggccggggagggaggga

SEQ ID NO: 10911 - RNA, 19 nt, Artificial Sequence
  Description of Artificial Sequence: Synthetic oligonucleotide
cggccggggagggagggga

SEQ ID NO: 10912 - RNA, 19 nt, Artificial Sequence
  Description of Artificial Sequence: Synthetic oligonucleotide
ggccggggagggaggggca

SEQ ID NO: 10913 - RNA, 19 nt, Artificial Sequence
  Description of Artificial Sequence: Synthetic oligonucleotide
gccggggagggaggggcca

SEQ ID NO: 10914 - RNA, 19 nt, Artificial Sequence
  Description of Artificial Sequence: Synthetic oligonucleotide
ccggggagggaggggccga

SEQ ID NO: 10915 - RNA, 19 nt, Artificial Sequence
  Description of Artificial Sequence: Synthetic oligonucleotide
cggggagggaggggccgga

SEQ ID NO: 10916 - RNA, 19 nt, Artificial Sequence
  Description of Artificial Sequence: Synthetic oligonucleotide
ggggagggaggggccggga

SEQ ID NO: 10917 - RNA, 19 nt, Artificial Sequence
  Description of Artificial Sequence: Synthetic oligonucleotide
gggagggaggggccgggua

SEQ ID NO: 10918 - RNA, 19 nt, Artificial Sequence
  Description of Artificial Sequence: Synthetic oligonucleotide
ggagggaggggccggguca

SEQ ID NO: 10919 - RNA, 19 nt, Artificial Sequence
  Description of Artificial Sequence: Synthetic oligonucleotide
gagggaggggccgggucca

SEQ ID NO: 10920 - RNA, 19 nt, Artificial Sequence
  Description of Artificial Sequence: Synthetic oligonucleotide
agggaggggccggguccga

SEQ ID NO: 10921 - RNA, 19 nt, Artificial Sequence
  Description of Artificial Sequence: Synthetic oligonucleotide
gggaggggccggguccgca

SEQ ID NO: 10922 - RNA, 19 nt, Artificial Sequence
  Description of Artificial Sequence: Synthetic oligonucleotide
ggaggggccggguccgcga

SEQ ID NO: 10923 - RNA, 19 nt, Artificial Sequence
  Description of Artificial Sequence: Synthetic oligonucleotide
gaggggccggguccgcgga

SEQ ID NO: 10924 - RNA, 19 nt, Artificial Sequence
  Description of Artificial Sequence: Synthetic oligonucleotide
aggggccggguccgcggca

SEQ ID NO: 10925 - RNA, 19 nt, Artificial Sequence
  Description of Artificial Sequence: Synthetic oligonucleotide
ggggccggguccgcggcca

SEQ ID NO: 10926 - RNA, 19 nt, Artificial Sequence
  Description of Artificial Sequence: Synthetic oligonucleotide
gggccggguccgcggccga

SEQ ID NO: 10927 - RNA, 19 nt, Artificial Sequence
  Description of Artificial Sequence: Synthetic oligonucleotide
ggccggguccgcggccgga

SEQ ID NO: 10928 - RNA, 19 nt, Artificial Sequence
  Description of Artificial Sequence: Synthetic oligonucleotide
gccggguccgcggccggca

SEQ ID NO: 10929 - RNA, 19 nt, Artificial Sequence
  Description of Artificial Sequence: Synthetic oligonucleotide
ccggguccgcggccggcga

SEQ ID NO: 10930 - RNA, 19 nt, Artificial Sequence
  Description of Artificial Sequence: Synthetic oligonucleotide
cggguccgcggccggcgaa

SEQ ID NO: 10931 - RNA, 19 nt, Artificial Sequence
  Description of Artificial Sequence: Synthetic oligonucleotide
ggguccgcggccggcgaaa

SEQ ID NO: 10932 - RNA, 19 nt, Artificial Sequence
  Description of Artificial Sequence: Synthetic oligonucleotide
gguccgcggccggcgaaca

SEQ ID NO: 10933 - RNA, 19 nt, Artificial Sequence
  Description of Artificial Sequence: Synthetic oligonucleotide
guccgcggccggcgaacga

SEQ ID NO: 10934 - RNA, 19 nt, Artificial Sequence
  Description of Artificial Sequence: Synthetic oligonucleotide
uccgcggccggcgaacgga

SEQ ID NO: 10935 - RNA, 19 nt, Artificial Sequence
  Description of Artificial Sequence: Synthetic oligonucleotide
ccgcggccggcgaacggga

SEQ ID NO: 10936 - RNA, 19 nt, Artificial Sequence
  Description of Artificial Sequence: Synthetic oligonucleotide
cgcggccggcgaacgggga

SEQ ID NO: 10937 - RNA, 19 nt, Artificial Sequence
  Description of Artificial Sequence: Synthetic oligonucleotide
gcggccggcgaacggggca

SEQ ID NO: 10938 - RNA, 19 nt, Artificial Sequence
  Description of Artificial Sequence: Synthetic oligonucleotide
cggccggcgaacggggcua

SEQ ID NO: 10939 - RNA, 19 nt, Artificial Sequence
  Description of Artificial Sequence: Synthetic oligonucleotide
ggccggcgaacggggcuca

SEQ ID NO: 10940 - RNA, 19 nt, Artificial Sequence
  Description of Artificial Sequence: Synthetic oligonucleotide
gccggcgaacggggcucga

SEQ ID NO: 10941 - RNA, 19 nt, Artificial Sequence
  Description of Artificial Sequence: Synthetic oligonucleotide
ccggcgaacggggcucgaa

SEQ ID NO: 10942 - RNA, 19 nt, Artificial Sequence
  Description of Artificial Sequence: Synthetic oligonucleotide
cggcgaacggggcucgaaa

SEQ ID NO: 10943 - RNA, 19 nt, Artificial Sequence
  Description of Artificial Sequence: Synthetic oligonucleotide
ggcgaacggggcucgaaga

SEQ ID NO: 10944 - RNA, 19 nt, Artificial Sequence
  Description of Artificial Sequence: Synthetic oligonucleotide
gcgaacggggcucgaagga

SEQ ID NO: 10945 - RNA, 19 nt, Artificial Sequence
  Description of Artificial Sequence: Synthetic oligonucleotide
cgaacggggcucgaaggga

SEQ ID NO: 10946 - RNA, 19 nt, Artificial Sequence
  Description of Artificial Sequence: Synthetic oligonucleotide
gaacggggcucgaagggua

SEQ ID NO: 10947 - RNA, 19 nt, Artificial Sequence
  Description of Artificial Sequence: Synthetic oligonucleotide
aacggggcucgaaggguca

SEQ ID NO: 10948 - RNA, 19 nt, Artificial Sequence
  Description of Artificial Sequence: Synthetic oligonucleotide
acggggcucgaagggucca

SEQ ID NO: 10949 - RNA, 19 nt, Artificial Sequence
  Description of Artificial Sequence: Synthetic oligonucleotide
cggggcucgaaggguccua

SEQ ID NO: 10950 - RNA, 19 nt, Artificial Sequence
  Description of Artificial Sequence: Synthetic oligonucleotide
ggggcucgaaggguccuua

SEQ ID NO: 10951 - RNA, 19 nt, Artificial Sequence
  Description of Artificial Sequence: Synthetic oligonucleotide
gggcucgaaggguccuuga

SEQ ID NO: 10952 - RNA, 19 nt, Artificial Sequence
  Description of Artificial Sequence: Synthetic oligonucleotide
ggcucgaaggguccuugua

SEQ ID NO: 10953 - RNA, 19 nt, Artificial Sequence
  Description of Artificial Sequence: Synthetic oligonucleotide
gcucgaaggguccuuguaa

SEQ ID NO: 10954 - RNA, 19 nt, Artificial Sequence
  Description of Artificial Sequence: Synthetic oligonucleotide
cucgaaggguccuuguaga

SEQ ID NO: 10955 - RNA, 19 nt, Artificial Sequence
  Description of Artificial Sequence: Synthetic oligonucleotide
ucgaaggguccuuguagca

SEQ ID NO: 10956 - RNA, 19 nt, Artificial Sequence
  Description of Artificial Sequence: Synthetic oligonucleotide
cgaaggguccuuguagcca

SEQ ID NO: 10957 - RNA, 19 nt, Artificial Sequence
  Description of Artificial Sequence: Synthetic oligonucleotide
gaaggguccuuguagccga

SEQ ID NO: 10958 - RNA, 19 nt, Artificial Sequence
  Description of Artificial Sequence: Synthetic oligonucleotide
aaggguccuuguagccgga

SEQ ID NO: 10959 - RNA, 19 nt, Artificial Sequence
  Description of Artificial Sequence: Synthetic oligonucleotide
aggguccuuguagccggga

SEQ ID NO: 10960 - RNA, 19 nt, Artificial Sequence
  Description of Artificial Sequence: Synthetic oligonucleotide
ggguccuuguagccgggaa

SEQ ID NO: 10961 - RNA, 19 nt, Artificial Sequence
  Description of Artificial Sequence: Synthetic oligonucleotide
gguccuuguagccgggaaa

SEQ ID NO: 10962 - RNA, 19 nt, Artificial Sequence
  Description of Artificial Sequence: Synthetic oligonucleotide
guccuuguagccgggaaua

SEQ ID NO: 10963 - RNA, 19 nt, Artificial Sequence
  Description of Artificial Sequence: Synthetic oligonucleotide
uccuuguagccgggaauga

SEQ ID NO: 10964 - RNA, 19 nt, Artificial Sequence
  Description of Artificial Sequence: Synthetic oligonucleotide
ccuuguagccgggaaugca

SEQ ID NO: 10965 - RNA, 19 nt, Artificial Sequence
  Description of Artificial Sequence: Synthetic oligonucleotide
cuuguagccgggaaugcua

SEQ ID NO: 10966 - RNA, 19 nt, Artificial Sequence
  Description of Artificial Sequence: Synthetic oligonucleotide
uuguagccgggaaugcuga

SEQ ID NO: 10967 - RNA, 19 nt, Artificial Sequence
  Description of Artificial Sequence: Synthetic oligonucleotide
uguagccgggaaugcugca

SEQ ID NO: 10968 - RNA, 19 nt, Artificial Sequence
  Description of Artificial Sequence: Synthetic oligonucleotide
guagccgggaaugcugcua

SEQ ID NO: 10969 - RNA, 19 nt, Artificial Sequence
  Description of Artificial Sequence: Synthetic oligonucleotide
uagccgggaaugcugcuga

SEQ ID NO: 10970 - RNA, 19 nt, Artificial Sequence
  Description of Artificial Sequence: Synthetic oligonucleotide
agccgggaaugcugcugca

SEQ ID NO: 10971 - RNA, 19 nt, Artificial Sequence
  Description of Artificial Sequence: Synthetic oligonucleotide
gccgggaaugcugcugcua

SEQ ID NO: 10972 - RNA, 19 nt, Artificial Sequence
  Description of Artificial Sequence: Synthetic oligonucleotide
ccgggaaugcugcugcuga

SEQ ID NO: 10973 - RNA, 19 nt, Artificial Sequence
  Description of Artificial Sequence: Synthetic oligonucleotide
cgggaaugcugcugcugca

SEQ ID NO: 10974 - RNA, 19 nt, Artificial Sequence
  Description of Artificial Sequence: Synthetic oligonucleotide
gggaaugcugcugcugcua

SEQ ID NO: 10975 - RNA, 19 nt, Artificial Sequence
  Description of Artificial Sequence: Synthetic oligonucleotide
ggaaugcugcugcugcuga

SEQ ID NO: 10976 - RNA, 19 nt, Artificial Sequence
  Description of Artificial Sequence: Synthetic oligonucleotide
gaaugcugcugcugcugca

SEQ ID NO: 10977 - RNA, 19 nt, Artificial Sequence
  Description of Artificial Sequence: Synthetic oligonucleotide
aaugcugcugcugcugcua

SEQ ID NO: 10978 - RNA, 19 nt, Artificial Sequence
  Description of Artificial Sequence: Synthetic oligonucleotide
augcugcugcugcugcuga

SEQ ID NO: 10979 - RNA, 19 nt, Artificial Sequence
  Description of Artificial Sequence: Synthetic oligonucleotide
ugcugcugcugcugcugca

SEQ ID NO: 10980 - RNA, 19 nt, Artificial Sequence
  Description of Artificial Sequence: Synthetic oligonucleotide
gcugcugcugcugcugcua

SEQ ID NO: 10981 - RNA, 19 nt, Artificial Sequence
  Description of Artificial Sequence: Synthetic oligonucleotide
cugcugcugcugcugcuga

SEQ ID NO: 10982 - RNA, 19 nt, Artificial Sequence
  Description of Artificial Sequence: Synthetic oligonucleotide
ugcugcugcugcugcugca

SEQ ID NO: 10983 - RNA, 19 nt, Artificial Sequence
  Description of Artificial Sequence: Synthetic oligonucleotide
gcugcugcugcugcugcua

SEQ ID NO: 10984 - RNA, 19 nt, Artificial Sequence
  Description of Artificial Sequence: Synthetic oligonucleotide
cugcugcugcugcugcuga

SEQ ID NO: 10985 - RNA, 19 nt, Artificial Sequence
  Description of Artificial Sequence: Synthetic oligonucleotide
ugcugcugcugcugcugca

SEQ ID NO: 10986 - RNA, 19 nt, Artificial Sequence
  Description of Artificial Sequence: Synthetic oligonucleotide
gcugcugcugcugcugcua

SEQ ID NO: 10987 - RNA, 19 nt, Artificial Sequence
  Description of Artificial Sequence: Synthetic oligonucleotide
cugcugcugcugcugcuga

SEQ ID NO: 10988 - RNA, 19 nt, Artificial Sequence
  Description of Artificial Sequence: Synthetic oligonucleotide
ugcugcugcugcugcugca

SEQ ID NO: 10989 - RNA, 19 nt, Artificial Sequence
  Description of Artificial Sequence: Synthetic oligonucleotide
gcugcugcugcugcugcua

SEQ ID NO: 10990 - RNA, 19 nt, Artificial Sequence
  Description of Artificial Sequence: Synthetic oligonucleotide
cugcugcugcugcugcuga

SEQ ID NO: 10991 - RNA, 19 nt, Artificial Sequence
  Description of Artificial Sequence: Synthetic oligonucleotide
ugcugcugcugcugcugca

SEQ ID NO: 10992 - RNA, 19 nt, Artificial Sequence
  Description of Artificial Sequence: Synthetic oligonucleotide
gcugcugcugcugcugcua

SEQ ID NO: 10993 - RNA, 19 nt, Artificial Sequence
  Description of Artificial Sequence: Synthetic oligonucleotide
cugcugcugcugcugcuga

SEQ ID NO: 10994 - RNA, 19 nt, Artificial Sequence
  Description of Artificial Sequence: Synthetic oligonucleotide
ugcugcugcugcugcugca

SEQ ID NO: 10995 - RNA, 19 nt, Artificial Sequence
  Description of Artificial Sequence: Synthetic oligonucleotide
gcugcugcugcugcugcua

SEQ ID NO: 10996 - RNA, 19 nt, Artificial Sequence
  Description of Artificial Sequence: Synthetic oligonucleotide
cugcugcugcugcugcuga

SEQ ID NO: 10997 - RNA, 19 nt, Artificial Sequence
  Description of Artificial Sequence: Synthetic oligonucleotide
ugcugcugcugcugcugca

SEQ ID NO: 10998 - RNA, 19 nt, Artificial Sequence
  Description of Artificial Sequence: Synthetic oligonucleotide
gcugcugcugcugcugcua

SEQ ID NO: 10999 - RNA, 19 nt, Artificial Sequence
  Description of Artificial Sequence: Synthetic oligonucleotide
cugcugcugcugcugcuga

SEQ ID NO: 11000 - RNA, 19 nt, Artificial Sequence
  Description of Artificial Sequence: Synthetic oligonucleotide
ugcugcugcugcugcugca

SEQ ID NO: 11001 - RNA, 19 nt, Artificial Sequence
  Description of Artificial Sequence: Synthetic oligonucleotide
gcugcugcugcugcugcua

SEQ ID NO: 11002 - RNA, 19 nt, Artificial Sequence
  Description of Artificial Sequence: Synthetic oligonucleotide
cugcugcugcugcugcuga

SEQ ID NO: 11003 - RNA, 19 nt, Artificial Sequence
  Description of Artificial Sequence: Synthetic oligonucleotide
ugcugcugcugcugcugca

SEQ ID NO: 11004 - RNA, 19 nt, Artificial Sequence
  Description of Artificial Sequence: Synthetic oligonucleotide
gcugcugcugcugcugcua

SEQ ID NO: 11005 - RNA, 19 nt, Artificial Sequence
  Description of Artificial Sequence: Synthetic oligonucleotide
cugcugcugcugcugcuga

SEQ ID NO: 11006 - RNA, 19 nt, Artificial Sequence
  Description of Artificial Sequence: Synthetic oligonucleotide
ugcugcugcugcugcugca

SEQ ID NO: 11007 - RNA, 19 nt, Artificial Sequence
  Description of Artificial Sequence: Synthetic oligonucleotide
gcugcugcugcugcugcua

SEQ ID NO: 11008 - RNA, 19 nt, Artificial Sequence
  Description of Artificial Sequence: Synthetic oligonucleotide
cugcugcugcugcugcuga

SEQ ID NO: 11009 - RNA, 19 nt, Artificial Sequence
  Description of Artificial Sequence: Synthetic oligonucleotide
ugcugcugcugcugcugca

SEQ ID NO: 11010 - RNA, 19 nt, Artificial Sequence
  Description of Artificial Sequence: Synthetic oligonucleotide
gcugcugcugcugcugcua

SEQ ID NO: 11011 - RNA, 19 nt, Artificial Sequence
  Description of Artificial Sequence: Synthetic oligonucleotide
cugcugcugcugcugcuga

SEQ ID NO: 11012 - RNA, 19 nt, Artificial Sequence
  Description of Artificial Sequence: Synthetic oligonucleotide
ugcugcugcugcugcugca

SEQ ID NO: 11013 - RNA, 19 nt, Artificial Sequence
  Description of Artificial Sequence: Synthetic oligonucleotide
gcugcugcugcugcugcua

SEQ ID NO: 11014 - RNA, 19 nt, Artificial Sequence
  Description of Artificial Sequence: Synthetic oligonucleotide
cugcugcugcugcugcuga

SEQ ID NO: 11015 - RNA, 19 nt, Artificial Sequence
  Description of Artificial Sequence: Synthetic oligonucleotide
ugcugcugcugcugcugca

SEQ ID NO: 11016 - RNA, 19 nt, Artificial Sequence
  Description of Artificial Sequence: Synthetic oligonucleotide
gcugcugcugcugcugcua

SEQ ID NO: 11017 - RNA, 19 nt, Artificial Sequence
  Description of Artificial Sequence: Synthetic oligonucleotide
cugcugcugcugcugcuga

SEQ ID NO: 11018 - RNA, 19 nt, Artificial Sequence
  Description of Artificial Sequence: Synthetic oligonucleotide
ugcugcugcugcugcugca

SEQ ID NO: 11019 - RNA, 19 nt, Artificial Sequence
  Description of Artificial Sequence: Synthetic oligonucleotide
gcugcugcugcugcugcua

SEQ ID NO: 11020 - RNA, 19 nt, Artificial Sequence
  Description of Artificial Sequence: Synthetic oligonucleotide
cugcugcugcugcugcuga

SEQ ID NO: 11021 - RNA, 19 nt, Artificial Sequence
  Description of Artificial Sequence: Synthetic oligonucleotide
ugcugcugcugcugcugca

SEQ ID NO: 11022 - RNA, 19 nt, Artificial Sequence
  Description of Artificial Sequence: Synthetic oligonucleotide
gcugcugcugcugcugcua

SEQ ID NO: 11023 - RNA, 19 nt, Artificial Sequence
  Description of Artificial Sequence: Synthetic oligonucleotide
cugcugcugcugcugcuga

SEQ ID NO: 11024 - RNA, 19 nt, Artificial Sequence
  Description of Artificial Sequence: Synthetic oligonucleotide
ugcugcugcugcugcugga

SEQ ID NO: 11025 - RNA, 19 nt, Artificial Sequence
  Description of Artificial Sequence: Synthetic oligonucleotide
gcugcugcugcugcuggga

SEQ ID NO: 11026 - RNA, 19 nt, Artificial Sequence
  Description of Artificial Sequence: Synthetic oligonucleotide
cugcugcugcugcugggga

SEQ ID NO: 11027 - RNA, 19 nt, Artificial Sequence
  Description of Artificial Sequence: Synthetic oligonucleotide
ugcugcugcugcuggggga

SEQ ID NO: 11028 - RNA, 19 nt, Artificial Sequence
  Description of Artificial Sequence: Synthetic oligonucleotide
gcugcugcugcugggggga

SEQ ID NO: 11029 - RNA, 19 nt, Artificial Sequence
  Description of Artificial Sequence: Synthetic oligonucleotide
cugcugcugcuggggggaa

SEQ ID NO: 11030 - RNA, 19 nt, Artificial Sequence
  Description of Artificial Sequence: Synthetic oligonucleotide
ugcugcugcuggggggaua

SEQ ID NO: 11031 - RNA, 19 nt, Artificial Sequence
  Description of Artificial Sequence: Synthetic oligonucleotide
gcugcugcuggggggauca

SEQ ID NO: 11032 - RNA, 19 nt, Artificial Sequence
  Description of Artificial Sequence: Synthetic oligonucleotide
cugcugcuggggggaucaa

SEQ ID NO: 11033 - RNA, 19 nt, Artificial Sequence
  Description of Artificial Sequence: Synthetic oligonucleotide
ugcugcuggggggaucaca

SEQ ID NO: 11034 - RNA, 19 nt, Artificial Sequence
  Description of Artificial Sequence: Synthetic oligonucleotide
gcugcuggggggaucacaa

SEQ ID NO: 11035 - RNA, 19 nt, Artificial Sequence
  Description of Artificial Sequence: Synthetic oligonucleotide
cugcuggggggaucacaga

SEQ ID NO: 11036 - RNA, 19 nt, Artificial Sequence
  Description of Artificial Sequence: Synthetic oligonucleotide
ugcuggggggaucacagaa

SEQ ID NO: 11037 - RNA, 19 nt, Artificial Sequence
  Description of Artificial Sequence: Synthetic oligonucleotide
gcuggggggaucacagaca

SEQ ID NO: 11038 - RNA, 19 nt, Artificial Sequence
  Description of Artificial Sequence: Synthetic oligonucleotide
cuggggggaucacagacca

SEQ ID NO: 11039 - RNA, 19 nt, Artificial Sequence
  Description of Artificial Sequence: Synthetic oligonucleotide
uggggggaucacagaccaa

SEQ ID NO: 11040 - RNA, 19 nt, Artificial Sequence
  Description of Artificial Sequence: Synthetic oligonucleotide
ggggggaucacagaccaua

SEQ ID NO: 11041 - RNA, 19 nt, Artificial Sequence
  Description of Artificial Sequence: Synthetic oligonucleotide
gggggaucacagaccauua

SEQ ID NO: 11042 - RNA, 19 nt, Artificial Sequence
  Description of Artificial Sequence: Synthetic oligonucleotide
ggggaucacagaccauuua

SEQ ID NO: 11043 - RNA, 19 nt, Artificial Sequence
  Description of Artificial Sequence: Synthetic oligonucleotide
gggaucacagaccauuuca

SEQ ID NO: 11044 - RNA, 19 nt, Artificial Sequence
  Description of Artificial Sequence: Synthetic oligonucleotide
ggaucacagaccauuucua

SEQ ID NO: 11045 - RNA, 19 nt, Artificial Sequence
  Description of Artificial Sequence: Synthetic oligonucleotide
gaucacagaccauuucuua

SEQ ID NO: 11046 - RNA, 19 nt, Artificial Sequence
  Description of Artificial Sequence: Synthetic oligonucleotide
aucacagaccauuucuuua

SEQ ID NO: 11047 - RNA, 19 nt, Artificial Sequence
  Description of Artificial Sequence: Synthetic oligonucleotide
ucacagaccauuucuuuca

SEQ ID NO: 11048 - RNA, 19 nt, Artificial Sequence
  Description of Artificial Sequence: Synthetic oligonucleotide
cacagaccauuucuuucua

SEQ ID NO: 11049 - RNA, 19 nt, Artificial Sequence
  Description of Artificial Sequence: Synthetic oligonucleotide
acagaccauuucuuucuua

SEQ ID NO: 11050 - RNA, 19 nt, Artificial Sequence
  Description of Artificial Sequence: Synthetic oligonucleotide
cagaccauuucuuucuuua

SEQ ID NO: 11051 - RNA, 19 nt, Artificial Sequence
  Description of Artificial Sequence: Synthetic oligonucleotide
agaccauuucuuucuuuca

SEQ ID NO: 11052 - RNA, 19 nt, Artificial Sequence
  Description of Artificial Sequence: Synthetic oligonucleotide
gaccauuucuuucuuucga

SEQ ID NO: 11053 - RNA, 19 nt, Artificial Sequence
  Description of Artificial Sequence: Synthetic oligonucleotide
accauuucuuucuuucgga

SEQ ID NO: 11054 - RNA, 19 nt, Artificial Sequence
  Description of Artificial Sequence: Synthetic oligonucleotide
ccauuucuuucuuucggca

SEQ ID NO: 11055 - RNA, 19 nt, Artificial Sequence
  Description of Artificial Sequence: Synthetic oligonucleotide
cauuucuuucuuucggcca

SEQ ID NO: 11056 - RNA, 19 nt, Artificial Sequence
  Description of Artificial Sequence: Synthetic oligonucleotide
auuucuuucuuucggccaa

SEQ ID NO: 11057 - RNA, 19 nt, Artificial Sequence
  Description of Artificial Sequence: Synthetic oligonucleotide
uuucuuucuuucggccaga

SEQ ID NO: 11058 - RNA, 19 nt, Artificial Sequence
  Description of Artificial Sequence: Synthetic oligonucleotide
uucuuucuuucggccagga

SEQ ID NO: 11059 - RNA, 19 nt, Artificial Sequence
  Description of Artificial Sequence: Synthetic oligonucleotide
ucuuucuuucggccaggca

SEQ ID NO: 11060 - RNA, 19 nt, Artificial Sequence
  Description of Artificial Sequence: Synthetic oligonucleotide
cuuucuuucggccaggcua

SEQ ID NO: 11061 - RNA, 19 nt, Artificial Sequence
  Description of Artificial Sequence: Synthetic oligonucleotide
uuucuuucggccaggcuga

SEQ ID NO: 11062 - RNA, 19 nt, Artificial Sequence
  Description of Artificial Sequence: Synthetic oligonucleotide
uucuuucggccaggcugaa

SEQ ID NO: 11063 - RNA, 19 nt, Artificial Sequence
  Description of Artificial Sequence: Synthetic oligonucleotide
ucuuucggccaggcugaga

SEQ ID NO: 11064 - RNA, 19 nt, Artificial Sequence
  Description of Artificial Sequence: Synthetic oligonucleotide
cuuucggccaggcugagga

SEQ ID NO: 11065 - RNA, 19 nt, Artificial Sequence
  Description of Artificial Sequence: Synthetic oligonucleotide
uuucggccaggcugaggca

SEQ ID NO: 11066 - RNA, 19 nt, Artificial Sequence
  Description of Artificial Sequence: Synthetic oligonucleotide
uucggccaggcugaggcca

SEQ ID NO: 11067 - RNA, 19 nt, Artificial Sequence
  Description of Artificial Sequence: Synthetic oligonucleotide
ucggccaggcugaggccca

SEQ ID NO: 11068 - RNA, 19 nt, Artificial Sequence
  Description of Artificial Sequence: Synthetic oligonucleotide
cggccaggcugaggcccua

SEQ ID NO: 11069 - RNA, 19 nt, Artificial Sequence
  Description of Artificial Sequence: Synthetic oligonucleotide
ggccaggcugaggcccuga

SEQ ID NO: 11070 - RNA, 19 nt, Artificial Sequence
  Description of Artificial Sequence: Synthetic oligonucleotide
gccaggcugaggcccugaa

SEQ ID NO: 11071 - RNA, 19 nt, Artificial Sequence
  Description of Artificial Sequence: Synthetic oligonucleotide
ccaggcugaggcccugaca

SEQ ID NO: 11072 - RNA, 19 nt, Artificial Sequence
  Description of Artificial Sequence: Synthetic oligonucleotide
caggcugaggcccugacga

SEQ ID NO: 11073 - RNA, 19 nt, Artificial Sequence
  Description of Artificial Sequence: Synthetic oligonucleotide
aggcugaggcccugacgua

SEQ ID NO: 11074 - RNA, 19 nt, Artificial Sequence
  Description of Artificial Sequence: Synthetic oligonucleotide
ggcugaggcccugacguga

SEQ ID NO: 11075 - RNA, 19 nt, Artificial Sequence
  Description of Artificial Sequence: Synthetic oligonucleotide
gcugaggcccugacgugga

SEQ ID NO: 11076 - RNA, 19 nt, Artificial Sequence
  Description of Artificial Sequence: Synthetic oligonucleotide
cugaggcccugacguggaa

SEQ ID NO: 11077 - RNA, 19 nt, Artificial Sequence
  Description of Artificial Sequence: Synthetic oligonucleotide
ugaggcccugacguggaua

SEQ ID NO: 11078 - RNA, 19 nt, Artificial Sequence
  Description of Artificial Sequence: Synthetic oligonucleotide
gaggcccugacguggauga

SEQ ID NO: 11079 - RNA, 19 nt, Artificial Sequence
  Description of Artificial Sequence: Synthetic oligonucleotide
aggcccugacguggaugga

SEQ ID NO: 11080 - RNA, 19 nt, Artificial Sequence
  Description of Artificial Sequence: Synthetic oligonucleotide
ggcccugacguggauggga

SEQ ID NO: 11081 - RNA, 19 nt, Artificial Sequence
  Description of Artificial Sequence: Synthetic oligonucleotide
gcccugacguggaugggca

SEQ ID NO: 11082 - RNA, 19 nt, Artificial Sequence
  Description of Artificial Sequence: Synthetic oligonucleotide
cccugacguggaugggcaa

SEQ ID NO: 11083 - RNA, 19 nt, Artificial Sequence
  Description of Artificial Sequence: Synthetic oligonucleotide
ccugacguggaugggcaaa

SEQ ID NO: 11084 - RNA, 19 nt, Artificial Sequence
  Description of Artificial Sequence: Synthetic oligonucleotide
cugacguggaugggcaaaa

SEQ ID NO: 11085 - RNA, 19 nt, Artificial Sequence
  Description of Artificial Sequence: Synthetic oligonucleotide
ugacguggaugggcaaaca

SEQ ID NO: 11086 - RNA, 19 nt, Artificial Sequence
  Description of Artificial Sequence: Synthetic oligonucleotide
gacguggaugggcaaacua

SEQ ID NO: 11087 - RNA, 19 nt, Artificial Sequence
  Description of Artificial Sequence: Synthetic oligonucleotide
acguggaugggcaaacuga

SEQ ID NO: 11088 - RNA, 19 nt, Artificial Sequence
  Description of Artificial Sequence: Synthetic oligonucleotide
cguggaugggcaaacugca

SEQ ID NO: 11089 - RNA, 19 nt, Artificial Sequence
  Description of Artificial Sequence: Synthetic oligonucleotide
guggaugggcaaacugcaa

SEQ ID NO: 11090 - RNA, 19 nt, Artificial Sequence
  Description of Artificial Sequence: Synthetic oligonucleotide
uggaugggcaaacugcaga

SEQ ID NO: 11091 - RNA, 19 nt, Artificial Sequence
  Description of Artificial Sequence: Synthetic oligonucleotide
ggaugggcaaacugcagga

SEQ ID NO: 11092 - RNA, 19 nt, Artificial Sequence
  Description of Artificial Sequence: Synthetic oligonucleotide
gaugggcaaacugcaggca

SEQ ID NO: 11093 - RNA, 19 nt, Artificial Sequence
  Description of Artificial Sequence: Synthetic oligonucleotide
augggcaaacugcaggcca

SEQ ID NO: 11094 - RNA, 19 nt, Artificial Sequence
  Description of Artificial Sequence: Synthetic oligonucleotide
ugggcaaacugcaggccua

SEQ ID NO: 11095 - RNA, 19 nt, Artificial Sequence
  Description of Artificial Sequence: Synthetic oligonucleotide
gggcaaacugcaggccuga

SEQ ID NO: 11096 - RNA, 19 nt, Artificial Sequence
  Description of Artificial Sequence: Synthetic oligonucleotide
ggcaaacugcaggccugga

SEQ ID NO: 11097 - RNA, 19 nt, Artificial Sequence
  Description of Artificial Sequence: Synthetic oligonucleotide
gcaaacugcaggccuggga

SEQ ID NO: 11098 - RNA, 19 nt, Artificial Sequence
  Description of Artificial Sequence: Synthetic oligonucleotide
caaacugcaggccugggaa

SEQ ID NO: 11099 - RNA, 19 nt, Artificial Sequence
  Description of Artificial Sequence: Synthetic oligonucleotide
aaacugcaggccugggaaa

SEQ ID NO: 11100 - RNA, 19 nt, Artificial Sequence
  Description of Artificial Sequence: Synthetic oligonucleotide
aacugcaggccugggaaga

SEQ ID NO: 11101 - RNA, 19 nt, Artificial Sequence
  Description of Artificial Sequence: Synthetic oligonucleotide
acugcaggccugggaagga

SEQ ID NO: 11102 - RNA, 19 nt, Artificial Sequence
  Description of Artificial Sequence: Synthetic oligonucleotide
cugcaggccugggaaggca

SEQ ID NO: 11103 - RNA, 19 nt, Artificial Sequence
  Description of Artificial Sequence: Synthetic oligonucleotide
ugcaggccugggaaggcaa

SEQ ID NO: 11104 - RNA, 19 nt, Artificial Sequence
  Description of Artificial Sequence: Synthetic oligonucleotide
gcaggccugggaaggcaga

SEQ ID NO: 11105 - RNA, 19 nt, Artificial Sequence
  Description of Artificial Sequence: Synthetic oligonucleotide
caggccugggaaggcagca

SEQ ID NO: 11106 - RNA, 19 nt, Artificial Sequence
  Description of Artificial Sequence: Synthetic oligonucleotide
aggccugggaaggcagcaa

SEQ ID NO: 11107 - RNA, 19 nt, Artificial Sequence
  Description of Artificial Sequence: Synthetic oligonucleotide
ggccugggaaggcagcaaa

SEQ ID NO: 11108 - RNA, 19 nt, Artificial Sequence
  Description of Artificial Sequence: Synthetic oligonucleotide
gccugggaaggcagcaaga

SEQ ID NO: 11109 - RNA, 19 nt, Artificial Sequence
  Description of Artificial Sequence: Synthetic oligonucleotide
ccugggaaggcagcaagca

SEQ ID NO: 11110 - RNA, 19 nt, Artificial Sequence
  Description of Artificial Sequence: Synthetic oligonucleotide
cugggaaggcagcaagcca

SEQ ID NO: 11111 - RNA, 19 nt, Artificial Sequence
  Description of Artificial Sequence: Synthetic oligonucleotide
ugggaaggcagcaagccga

SEQ ID NO: 11112 - RNA, 19 nt, Artificial Sequence
  Description of Artificial Sequence: Synthetic oligonucleotide
gggaaggcagcaagccgga

SEQ ID NO: 11113 - RNA, 19 nt, Artificial Sequence
  Description of Artificial Sequence: Synthetic oligonucleotide
ggaaggcagcaagccggga

SEQ ID NO: 11114 - RNA, 19 nt, Artificial Sequence
  Description of Artificial Sequence: Synthetic oligonucleotide
gaaggcagcaagccgggca

SEQ ID NO: 11115 - RNA, 19 nt, Artificial Sequence
  Description of Artificial Sequence: Synthetic oligonucleotide
aaggcagcaagccgggcca

SEQ ID NO: 11116 - RNA, 19 nt, Artificial Sequence
  Description of Artificial Sequence: Synthetic oligonucleotide
aggcagcaagccgggccga

SEQ ID NO: 11117 - RNA, 19 nt, Artificial Sequence
  Description of Artificial Sequence: Synthetic oligonucleotide
ggcagcaagccgggccgua

SEQ ID NO: 11118 - RNA, 19 nt, Artificial Sequence
  Description of Artificial Sequence: Synthetic oligonucleotide
gcagcaagccgggccguca

SEQ ID NO: 11119 - RNA, 19 nt, Artificial Sequence
  Description of Artificial Sequence: Synthetic oligonucleotide
cagcaagccgggccgucca

SEQ ID NO: 11120 - RNA, 19 nt, Artificial Sequence
  Description of Artificial Sequence: Synthetic oligonucleotide
agcaagccgggccguccga

SEQ ID NO: 11121 - RNA, 19 nt, Artificial Sequence
  Description of Artificial Sequence: Synthetic oligonucleotide
gcaagccgggccguccgua

SEQ ID NO: 11122 - RNA, 19 nt, Artificial Sequence
  Description of Artificial Sequence: Synthetic oligonucleotide
caagccgggccguccguga

SEQ ID NO: 11123 - RNA, 19 nt, Artificial Sequence
  Description of Artificial Sequence: Synthetic oligonucleotide
aagccgggccguccgugua

SEQ ID NO: 11124 - RNA, 19 nt, Artificial Sequence
  Description of Artificial Sequence: Synthetic oligonucleotide
agccgggccguccguguua

SEQ ID NO: 11125 - RNA, 19 nt, Artificial Sequence
  Description of Artificial Sequence: Synthetic oligonucleotide
gccgggccguccguguuca

SEQ ID NO: 11126 - RNA, 19 nt, Artificial Sequence
  Description of Artificial Sequence: Synthetic oligonucleotide
ccgggccguccguguucca

SEQ ID NO: 11127 - RNA, 19 nt, Artificial Sequence
  Description of Artificial Sequence: Synthetic oligonucleotide
cgggccguccguguuccaa

SEQ ID NO: 11128 - RNA, 19 nt, Artificial Sequence
  Description of Artificial Sequence: Synthetic oligonucleotide
gggccguccguguuccaua

SEQ ID NO: 11129 - RNA, 19 nt, Artificial Sequence
  Description of Artificial Sequence: Synthetic oligonucleotide
ggccguccguguuccauca

SEQ ID NO: 11130 - RNA, 19 nt, Artificial Sequence
  Description of Artificial Sequence: Synthetic oligonucleotide
gccguccguguuccaucca

SEQ ID NO: 11131 - RNA, 19 nt, Artificial Sequence
  Description of Artificial Sequence: Synthetic oligonucleotide
ccguccguguuccauccua

SEQ ID NO: 11132 - RNA, 19 nt, Artificial Sequence
  Description of Artificial Sequence: Synthetic oligonucleotide
cguccguguuccauccuca

SEQ ID NO: 11133 - RNA, 19 nt, Artificial Sequence
  Description of Artificial Sequence: Synthetic oligonucleotide
guccguguuccauccucca

SEQ ID NO: 11134 - RNA, 19 nt, Artificial Sequence
  Description of Artificial Sequence: Synthetic oligonucleotide
uccguguuccauccuccaa

SEQ ID NO: 11135 - RNA, 19 nt, Artificial Sequence
  Description of Artificial Sequence: Synthetic oligonucleotide
ccguguuccauccuccaca

SEQ ID NO: 11136 - RNA, 19 nt, Artificial Sequence
  Description of Artificial Sequence: Synthetic oligonucleotide
cguguuccauccuccacga

SEQ ID NO: 11137 - RNA, 19 nt, Artificial Sequence
  Description of Artificial Sequence: Synthetic oligonucleotide
guguuccauccuccacgca

SEQ ID NO: 11138 - RNA, 19 nt, Artificial Sequence
  Description of Artificial Sequence: Synthetic oligonucleotide
uguuccauccuccacgcaa

SEQ ID NO: 11139 - RNA, 19 nt, Artificial Sequence
  Description of Artificial Sequence: Synthetic oligonucleotide
guuccauccuccacgcaca

SEQ ID NO: 11140 - RNA, 19 nt, Artificial Sequence
  Description of Artificial Sequence: Synthetic oligonucleotide
uuccauccuccacgcacca

SEQ ID NO: 11141 - RNA, 19 nt, Artificial Sequence
  Description of Artificial Sequence: Synthetic oligonucleotide
uccauccuccacgcaccca

SEQ ID NO: 11142 - RNA, 19 nt, Artificial Sequence
  Description of Artificial Sequence: Synthetic oligonucleotide
ccauccuccacgcacccca

SEQ ID NO: 11143 - RNA, 19 nt, Artificial Sequence
  Description of Artificial Sequence: Synthetic oligonucleotide
cauccuccacgcaccccca

SEQ ID NO: 11144 - RNA, 19 nt, Artificial Sequence
  Description of Artificial Sequence: Synthetic oligonucleotide
auccuccacgcacccccaa

SEQ ID NO: 11145 - RNA, 19 nt, Artificial Sequence
  Description of Artificial Sequence: Synthetic oligonucleotide
uccuccacgcacccccaca

SEQ ID NO: 11146 - RNA, 19 nt, Artificial Sequence
  Description of Artificial Sequence: Synthetic oligonucleotide
ccuccacgcacccccacca

SEQ ID NO: 11147 - RNA, 19 nt, Artificial Sequence
  Description of Artificial Sequence: Synthetic oligonucleotide
cuccacgcacccccaccua

SEQ ID NO: 11148 - RNA, 19 nt, Artificial Sequence
  Description of Artificial Sequence: Synthetic oligonucleotide
uccacgcacccccaccuaa

SEQ ID NO: 11149 - RNA, 19 nt, Artificial Sequence
  Description of Artificial Sequence: Synthetic oligonucleotide
ccacgcacccccaccuaua

SEQ ID NO: 11150 - RNA, 19 nt, Artificial Sequence
  Description of Artificial Sequence: Synthetic oligonucleotide
cacgcacccccaccuauca

SEQ ID NO: 11151 - RNA, 19 nt, Artificial Sequence
  Description of Artificial Sequence: Synthetic oligonucleotide
acgcacccccaccuaucga

SEQ ID NO: 11152 - RNA, 19 nt, Artificial Sequence
  Description of Artificial Sequence: Synthetic oligonucleotide
cgcacccccaccuaucgua

SEQ ID NO: 11153 - RNA, 19 nt, Artificial Sequence
  Description of Artificial Sequence: Synthetic oligonucleotide
gcacccccaccuaucguua

SEQ ID NO: 11154 - RNA, 19 nt, Artificial Sequence
  Description of Artificial Sequence: Synthetic oligonucleotide
cacccccaccuaucguuga

SEQ ID NO: 11155 - RNA, 19 nt, Artificial Sequence
  Description of Artificial Sequence: Synthetic oligonucleotide
acccccaccuaucguugga

SEQ ID NO: 11156 - RNA, 19 nt, Artificial Sequence
  Description of Artificial Sequence: Synthetic oligonucleotide
cccccaccuaucguuggua

SEQ ID NO: 11157 - RNA, 19 nt, Artificial Sequence
  Description of Artificial Sequence: Synthetic oligonucleotide
ccccaccuaucguugguua

SEQ ID NO: 11158 - RNA, 19 nt, Artificial Sequence
  Description of Artificial Sequence: Synthetic oligonucleotide
cccaccuaucguugguuca

SEQ ID NO: 11159 - RNA, 19 nt, Artificial Sequence
  Description of Artificial Sequence: Synthetic oligonucleotide
ccaccuaucguugguucga

SEQ ID NO: 11160 - RNA, 19 nt, Artificial Sequence
  Description of Artificial Sequence: Synthetic oligonucleotide
caccuaucguugguucgca

SEQ ID NO: 11161 - RNA, 19 nt, Artificial Sequence
  Description of Artificial Sequence: Synthetic oligonucleotide
accuaucguugguucgcaa

SEQ ID NO: 11162 - RNA, 19 nt, Artificial Sequence
  Description of Artificial Sequence: Synthetic oligonucleotide
ccuaucguugguucgcaaa

SEQ ID NO: 11163 - RNA, 19 nt, Artificial Sequence
  Description of Artificial Sequence: Synthetic oligonucleotide
cuaucguugguucgcaaaa

SEQ ID NO: 11164 - RNA, 19 nt, Artificial Sequence
  Description of Artificial Sequence: Synthetic oligonucleotide
uaucguugguucgcaaaga

SEQ ID NO: 11165 - RNA, 19 nt, Artificial Sequence
  Description of Artificial Sequence: Synthetic oligonucleotide
aucguugguucgcaaagua

SEQ ID NO: 11166 - RNA, 19 nt, Artificial Sequence
  Description of Artificial Sequence: Synthetic oligonucleotide
ucguugguucgcaaaguga

SEQ ID NO: 11167 - RNA, 19 nt, Artificial Sequence
  Description of Artificial Sequence: Synthetic oligonucleotide
cguugguucgcaaagugca

SEQ ID NO: 11168 - RNA, 19 nt, Artificial Sequence
  Description of Artificial Sequence: Synthetic oligonucleotide
guugguucgcaaagugcaa

SEQ ID NO: 11169 - RNA, 19 nt, Artificial Sequence
  Description of Artificial Sequence: Synthetic oligonucleotide
uugguucgcaaagugcaaa

SEQ ID NO: 11170 - RNA, 19 nt, Artificial Sequence
  Description of Artificial Sequence: Synthetic oligonucleotide
ugguucgcaaagugcaaaa

SEQ ID NO: 11171 - RNA, 19 nt, Artificial Sequence
  Description of Artificial Sequence: Synthetic oligonucleotide
gguucgcaaagugcaaaga

SEQ ID NO: 11172 - RNA, 19 nt, Artificial Sequence
  Description of Artificial Sequence: Synthetic oligonucleotide
guucgcaaagugcaaagca

SEQ ID NO: 11173 - RNA, 19 nt, Artificial Sequence
  Description of Artificial Sequence: Synthetic oligonucleotide
uucgcaaagugcaaagcua

SEQ ID NO: 11174 - RNA, 19 nt, Artificial Sequence
  Description of Artificial Sequence: Synthetic oligonucleotide
ucgcaaagugcaaagcuua

SEQ ID NO: 11175 - RNA, 19 nt, Artificial Sequence
  Description of Artificial Sequence: Synthetic oligonucleotide
cgcaaagugcaaagcuuua

SEQ ID NO: 11176 - RNA, 19 nt, Artificial Sequence
  Description of Artificial Sequence: Synthetic oligonucleotide
gcaaagugcaaagcuuuca

SEQ ID NO: 11177 - RNA, 19 nt, Artificial Sequence
  Description of Artificial Sequence: Synthetic oligonucleotide
caaagugcaaagcuuucua

SEQ ID NO: 11178 - RNA, 19 nt, Artificial Sequence
  Description of Artificial Sequence: Synthetic oligonucleotide
aaagugcaaagcuuucuua

SEQ ID NO: 11179 - RNA, 19 nt, Artificial Sequence
  Description of Artificial Sequence: Synthetic oligonucleotide
aagugcaaagcuuucuuga

SEQ ID NO: 11180 - RNA, 19 nt, Artificial Sequence
  Description of Artificial Sequence: Synthetic oligonucleotide
agugcaaagcuuucuugua

SEQ ID NO: 11181 - RNA, 19 nt, Artificial Sequence
  Description of Artificial Sequence: Synthetic oligonucleotide
gugcaaagcuuucuuguga

SEQ ID NO: 11182 - RNA, 19 nt, Artificial Sequence
  Description of Artificial Sequence: Synthetic oligonucleotide
ugcaaagcuuucuugugca

SEQ ID NO: 11183 - RNA, 19 nt, Artificial Sequence
  Description of Artificial Sequence: Synthetic oligonucleotide
gcaaagcuuucuugugcaa

SEQ ID NO: 11184 - RNA, 19 nt, Artificial Sequence
  Description of Artificial Sequence: Synthetic oligonucleotide
caaagcuuucuugugcaua

SEQ ID NO: 11185 - RNA, 19 nt, Artificial Sequence
  Description of Artificial Sequence: Synthetic oligonucleotide
aaagcuuucuugugcauga

SEQ ID NO: 11186 - RNA, 19 nt, Artificial Sequence
  Description of Artificial Sequence: Synthetic oligonucleotide
aagcuuucuugugcaugaa

SEQ ID NO: 11187 - RNA, 19 nt, Artificial Sequence
  Description of Artificial Sequence: Synthetic oligonucleotide
agcuuucuugugcaugaca

SEQ ID NO: 11188 - RNA, 19 nt, Artificial Sequence
  Description of Artificial Sequence: Synthetic oligonucleotide
gcuuucuugugcaugacga

SEQ ID NO: 11189 - RNA, 19 nt, Artificial Sequence
  Description of Artificial Sequence: Synthetic oligonucleotide
cuuucuugugcaugacgca

SEQ ID NO: 11190 - RNA, 19 nt, Artificial Sequence
  Description of Artificial Sequence: Synthetic oligonucleotide
uuucuugugcaugacgcca

SEQ ID NO: 11191 - RNA, 19 nt, Artificial Sequence
  Description of Artificial Sequence: Synthetic oligonucleotide
uucuugugcaugacgccca

SEQ ID NO: 11192 - RNA, 19 nt, Artificial Sequence
  Description of Artificial Sequence: Synthetic oligonucleotide
ucuugugcaugacgcccua

SEQ ID NO: 11193 - RNA, 19 nt, Artificial Sequence
  Description of Artificial Sequence: Synthetic oligonucleotide
cuugugcaugacgcccuga

SEQ ID NO: 11194 - RNA, 19 nt, Artificial Sequence
  Description of Artificial Sequence: Synthetic oligonucleotide
uugugcaugacgcccugca

SEQ ID NO: 11195 - RNA, 19 nt, Artificial Sequence
  Description of Artificial Sequence: Synthetic oligonucleotide
ugugcaugacgcccugcua

SEQ ID NO: 11196 - RNA, 19 nt, Artificial Sequence
  Description of Artificial Sequence: Synthetic oligonucleotide
gugcaugacgcccugcuca

SEQ ID NO: 11197 - RNA, 19 nt, Artificial Sequence
  Description of Artificial Sequence: Synthetic oligonucleotide
ugcaugacgcccugcucua

SEQ ID NO: 11198 - RNA, 19 nt, Artificial Sequence
  Description of Artificial Sequence: Synthetic oligonucleotide
gcaugacgcccugcucuga

SEQ ID NO: 11199 - RNA, 19 nt, Artificial Sequence
  Description of Artificial Sequence: Synthetic oligonucleotide
caugacgcccugcucugga

SEQ ID NO: 11200 - RNA, 19 nt, Artificial Sequence
  Description of Artificial Sequence: Synthetic oligonucleotide
augacgcccugcucuggga

SEQ ID NO: 11201 - RNA, 19 nt, Artificial Sequence
  Description of Artificial Sequence: Synthetic oligonucleotide
ugacgcccugcucugggga

SEQ ID NO: 11202 - RNA, 19 nt, Artificial Sequence
  Description of Artificial Sequence: Synthetic oligonucleotide
gacgcccugcucuggggaa

SEQ ID NO: 11203 - RNA, 19 nt, Artificial Sequence
  Description of Artificial Sequence: Synthetic oligonucleotide
acgcccugcucuggggaga

SEQ ID NO: 11204 - RNA, 19 nt, Artificial Sequence
  Description of Artificial Sequence: Synthetic oligonucleotide
cgcccugcucuggggagca

SEQ ID NO: 11205 - RNA, 19 nt, Artificial Sequence
  Description of Artificial Sequence: Synthetic oligonucleotide
gcccugcucuggggagcga

SEQ ID NO: 11206 - RNA, 19 nt, Artificial Sequence
  Description of Artificial Sequence: Synthetic oligonucleotide
cccugcucuggggagcgua

SEQ ID NO: 11207 - RNA, 19 nt, Artificial Sequence
  Description of Artificial Sequence: Synthetic oligonucleotide
ccugcucuggggagcguca

SEQ ID NO: 11208 - RNA, 19 nt, Artificial Sequence
  Description of Artificial Sequence: Synthetic oligonucleotide
cugcucuggggagcgucua

SEQ ID NO: 11209 - RNA, 19 nt, Artificial Sequence
  Description of Artificial Sequence: Synthetic oligonucleotide
ugcucuggggagcgucuga

SEQ ID NO: 11210 - RNA, 19 nt, Artificial Sequence
  Description of Artificial Sequence: Synthetic oligonucleotide
gcucuggggagcgucugga

SEQ ID NO: 11211 - RNA, 19 nt, Artificial Sequence
  Description of Artificial Sequence: Synthetic oligonucleotide
cucuggggagcgucuggca

SEQ ID NO: 11212 - RNA, 19 nt, Artificial Sequence
  Description of Artificial Sequence: Synthetic oligonucleotide
ucuggggagcgucuggcga

SEQ ID NO: 11213 - RNA, 19 nt, Artificial Sequence
  Description of Artificial Sequence: Synthetic oligonucleotide
cuggggagcgucuggcgca

SEQ ID NO: 11214 - RNA, 19 nt, Artificial Sequence
  Description of Artificial Sequence: Synthetic oligonucleotide
uggggagcgucuggcgcga

SEQ ID NO: 11215 - RNA, 19 nt, Artificial Sequence
  Description of Artificial Sequence: Synthetic oligonucleotide
ggggagcgucuggcgcgaa

SEQ ID NO: 11216 - RNA, 19 nt, Artificial Sequence
  Description of Artificial Sequence: Synthetic oligonucleotide
gggagcgucuggcgcgaua

SEQ ID NO: 11217 - RNA, 19 nt, Artificial Sequence
  Description of Artificial Sequence: Synthetic oligonucleotide
ggagcgucuggcgcgauca

SEQ ID NO: 11218 - RNA, 19 nt, Artificial Sequence
  Description of Artificial Sequence: Synthetic oligonucleotide
gagcgucuggcgcgaucua

SEQ ID NO: 11219 - RNA, 19 nt, Artificial Sequence
  Description of Artificial Sequence: Synthetic oligonucleotide
agcgucuggcgcgaucuca

SEQ ID NO: 11220 - RNA, 19 nt, Artificial Sequence
  Description of Artificial Sequence: Synthetic oligonucleotide
gcgucuggcgcgaucucua

SEQ ID NO: 11221 - RNA, 19 nt, Artificial Sequence
  Description of Artificial Sequence: Synthetic oligonucleotide
cgucuggcgcgaucucuga

SEQ ID NO: 11222 - RNA, 19 nt, Artificial Sequence
  Description of Artificial Sequence: Synthetic oligonucleotide
gucuggcgcgaucucugca

SEQ ID NO: 11223 - RNA, 19 nt, Artificial Sequence
  Description of Artificial Sequence: Synthetic oligonucleotide
ucuggcgcgaucucugcca

SEQ ID NO: 11224 - RNA, 19 nt, Artificial Sequence
  Description of Artificial Sequence: Synthetic oligonucleotide
cuggcgcgaucucugccua

SEQ ID NO: 11225 - RNA, 19 nt, Artificial Sequence
  Description of Artificial Sequence: Synthetic oligonucleotide
uggcgcgaucucugccuga

SEQ ID NO: 11226 - RNA, 19 nt, Artificial Sequence
  Description of Artificial Sequence: Synthetic oligonucleotide
ggcgcgaucucugccugca

SEQ ID NO: 11227 - RNA, 19 nt, Artificial Sequence
  Description of Artificial Sequence: Synthetic oligonucleotide
gcgcgaucucugccugcua

SEQ ID NO: 11228 - RNA, 19 nt, Artificial Sequence
  Description of Artificial Sequence: Synthetic oligonucleotide
cgcgaucucugccugcuua

SEQ ID NO: 11229 - RNA, 19 nt, Artificial Sequence
  Description of Artificial Sequence: Synthetic oligonucleotide
gcgaucucugccugcuuaa

SEQ ID NO: 11230 - RNA, 19 nt, Artificial Sequence
  Description of Artificial Sequence: Synthetic oligonucleotide
cgaucucugccugcuuaca

SEQ ID NO: 11231 - RNA, 19 nt, Artificial Sequence
  Description of Artificial Sequence: Synthetic oligonucleotide
gaucucugccugcuuacua

SEQ ID NO: 11232 - RNA, 19 nt, Artificial Sequence
  Description of Artificial Sequence: Synthetic oligonucleotide
aucucugccugcuuacuca

SEQ ID NO: 11233 - RNA, 19 nt, Artificial Sequence
  Description of Artificial Sequence: Synthetic oligonucleotide
ucucugccugcuuacucga

SEQ ID NO: 11234 - RNA, 19 nt, Artificial Sequence
  Description of Artificial Sequence: Synthetic oligonucleotide
cucugccugcuuacucgga

SEQ ID NO: 11235 - RNA, 19 nt, Artificial Sequence
  Description of Artificial Sequence: Synthetic oligonucleotide
ucugccugcuuacucggga

SEQ ID NO: 11236 - RNA, 19 nt, Artificial Sequence
  Description of Artificial Sequence: Synthetic oligonucleotide
cugccugcuuacucgggaa

SEQ ID NO: 11237 - RNA, 19 nt, Artificial Sequence
  Description of Artificial Sequence: Synthetic oligonucleotide
ugccugcuuacucgggaaa

SEQ ID NO: 11238 - RNA, 19 nt, Artificial Sequence
  Description of Artificial Sequence: Synthetic oligonucleotide
gccugcuuacucgggaaaa

SEQ ID NO: 11239 - RNA, 19 nt, Artificial Sequence
  Description of Artificial Sequence: Synthetic oligonucleotide
ccugcuuacucgggaaaua

SEQ ID NO: 11240 - RNA, 19 nt, Artificial Sequence
  Description of Artificial Sequence: Synthetic oligonucleotide
cugcuuacucgggaaauua

SEQ ID NO: 11241 - RNA, 19 nt, Artificial Sequence
  Description of Artificial Sequence: Synthetic oligonucleotide
ugcuuacucgggaaauuua

SEQ ID NO: 11242 - RNA, 19 nt, Artificial Sequence
  Description of Artificial Sequence: Synthetic oligonucleotide
gcuuacucgggaaauuuga

SEQ ID NO: 11243 - RNA, 19 nt, Artificial Sequence
  Description of Artificial Sequence: Synthetic oligonucleotide
cuuacucgggaaauuugca

SEQ ID NO: 11244 - RNA, 19 nt, Artificial Sequence
  Description of Artificial Sequence: Synthetic oligonucleotide
uuacucgggaaauuugcua

SEQ ID NO: 11245 - RNA, 19 nt, Artificial Sequence
  Description of Artificial Sequence: Synthetic oligonucleotide
uacucgggaaauuugcuua

SEQ ID NO: 11246 - RNA, 19 nt, Artificial Sequence
  Description of Artificial Sequence: Synthetic oligonucleotide
acucgggaaauuugcuuua

SEQ ID NO: 11247 - RNA, 19 nt, Artificial Sequence
  Description of Artificial Sequence: Synthetic oligonucleotide
cucgggaaauuugcuuuua

SEQ ID NO: 11248 - RNA, 19 nt, Artificial Sequence
  Description of Artificial Sequence: Synthetic oligonucleotide
ucgggaaauuugcuuuuga

SEQ ID NO: 11249 - RNA, 19 nt, Artificial Sequence
  Description of Artificial Sequence: Synthetic oligonucleotide
cgggaaauuugcuuuugca

SEQ ID NO: 11250 - RNA, 19 nt, Artificial Sequence
  Description of Artificial Sequence: Synthetic oligonucleotide
gggaaauuugcuuuugcca

SEQ ID NO: 11251 - RNA, 19 nt, Artificial Sequence
  Description of Artificial Sequence: Synthetic oligonucleotide
ggaaauuugcuuuugccaa

SEQ ID NO: 11252 - RNA, 19 nt, Artificial Sequence
  Description of Artificial Sequence: Synthetic oligonucleotide
gaaauuugcuuuugccaaa

SEQ ID NO: 11253 - RNA, 19 nt, Artificial Sequence
  Description of Artificial Sequence: Synthetic oligonucleotide
aaauuugcuuuugccaaaa

SEQ ID NO: 11254 - RNA, 19 nt, Artificial Sequence
  Description of Artificial Sequence: Synthetic oligonucleotide
aauuugcuuuugccaaaca

SEQ ID NO: 11255 - RNA, 19 nt, Artificial Sequence
  Description of Artificial Sequence: Synthetic oligonucleotide
auuugcuuuugccaaacca

SEQ ID NO: 11256 - RNA, 19 nt, Artificial Sequence
  Description of Artificial Sequence: Synthetic oligonucleotide
uuugcuuuugccaaaccca

SEQ ID NO: 11257 - RNA, 19 nt, Artificial Sequence
  Description of Artificial Sequence: Synthetic oligonucleotide
uugcuuuugccaaacccga

SEQ ID NO: 11258 - RNA, 19 nt, Artificial Sequence
  Description of Artificial Sequence: Synthetic oligonucleotide
ugcuuuugccaaacccgca

SEQ ID NO: 11259 - RNA, 19 nt, Artificial Sequence
  Description of Artificial Sequence: Synthetic oligonucleotide
gcuuuugccaaacccgcua

SEQ ID NO: 11260 - RNA, 19 nt, Artificial Sequence
  Description of Artificial Sequence: Synthetic oligonucleotide
cuuuugccaaacccgcuua

SEQ ID NO: 11261 - RNA, 19 nt, Artificial Sequence
  Description of Artificial Sequence: Synthetic oligonucleotide
uuuugccaaacccgcuuua

SEQ ID NO: 11262 - RNA, 19 nt, Artificial Sequence
  Description of Artificial Sequence: Synthetic oligonucleotide
uuugccaaacccgcuuuua

SEQ ID NO: 11263 - RNA, 19 nt, Artificial Sequence
  Description of Artificial Sequence: Synthetic oligonucleotide
uugccaaacccgcuuuuua

SEQ ID NO: 11264 - RNA, 19 nt, Artificial Sequence
  Description of Artificial Sequence: Synthetic oligonucleotide
ugccaaacccgcuuuuuca

SEQ ID NO: 11265 - RNA, 19 nt, Artificial Sequence
  Description of Artificial Sequence: Synthetic oligonucleotide
gccaaacccgcuuuuucga

SEQ ID NO: 11266 - RNA, 19 nt, Artificial Sequence
  Description of Artificial Sequence: Synthetic oligonucleotide
ccaaacccgcuuuuucgga

SEQ ID NO: 11267 - RNA, 19 nt, Artificial Sequence
  Description of Artificial Sequence: Synthetic oligonucleotide
caaacccgcuuuuucggga

SEQ ID NO: 11268 - RNA, 19 nt, Artificial Sequence
  Description of Artificial Sequence: Synthetic oligonucleotide
aaacccgcuuuuucgggga

SEQ ID NO: 11269 - RNA, 19 nt, Artificial Sequence
  Description of Artificial Sequence: Synthetic oligonucleotide
aacccgcuuuuucggggaa

SEQ ID NO: 11270 - RNA, 19 nt, Artificial Sequence
  Description of Artificial Sequence: Synthetic oligonucleotide
acccgcuuuuucggggaua

SEQ ID NO: 11271 - RNA, 19 nt, Artificial Sequence
  Description of Artificial Sequence: Synthetic oligonucleotide
cccgcuuuuucggggauca

SEQ ID NO: 11272 - RNA, 19 nt, Artificial Sequence
  Description of Artificial Sequence: Synthetic oligonucleotide
ccgcuuuuucggggaucca

SEQ ID NO: 11273 - RNA, 19 nt, Artificial Sequence
  Description of Artificial Sequence: Synthetic oligonucleotide
cgcuuuuucggggauccca

SEQ ID NO: 11274 - RNA, 19 nt, Artificial Sequence
  Description of Artificial Sequence: Synthetic oligonucleotide
gcuuuuucggggaucccga

SEQ ID NO: 11275 - RNA, 19 nt, Artificial Sequence
  Description of Artificial Sequence: Synthetic oligonucleotide
cuuuuucggggaucccgca

SEQ ID NO: 11276 - RNA, 19 nt, Artificial Sequence
  Description of Artificial Sequence: Synthetic oligonucleotide
uuuuucggggaucccgcga

SEQ ID NO: 11277 - RNA, 19 nt, Artificial Sequence
  Description of Artificial Sequence: Synthetic oligonucleotide
uuuucggggaucccgcgca

SEQ ID NO: 11278 - RNA, 19 nt, Artificial Sequence
  Description of Artificial Sequence: Synthetic oligonucleotide
uuucggggaucccgcgcca

SEQ ID NO: 11279 - RNA, 19 nt, Artificial Sequence
  Description of Artificial Sequence: Synthetic oligonucleotide
uucggggaucccgcgccca

SEQ ID NO: 11280 - RNA, 19 nt, Artificial Sequence
  Description of Artificial Sequence: Synthetic oligonucleotide
ucggggaucccgcgcccca

SEQ ID NO: 11281 - RNA, 19 nt, Artificial Sequence
  Description of Artificial Sequence: Synthetic oligonucleotide
cggggaucccgcgccccca

SEQ ID NO: 11282 - RNA, 19 nt, Artificial Sequence
  Description of Artificial Sequence: Synthetic oligonucleotide
ggggaucccgcgcccccca

SEQ ID NO: 11283 - RNA, 19 nt, Artificial Sequence
  Description of Artificial Sequence: Synthetic oligonucleotide
gggaucccgcgccccccua

SEQ ID NO: 11284 - RNA, 19 nt, Artificial Sequence
  Description of Artificial Sequence: Synthetic oligonucleotide
ggaucccgcgccccccuca

SEQ ID NO: 11285 - RNA, 19 nt, Artificial Sequence
  Description of Artificial Sequence: Synthetic oligonucleotide
gaucccgcgccccccucca

SEQ ID NO: 11286 - RNA, 19 nt, Artificial Sequence
  Description of Artificial Sequence: Synthetic oligonucleotide
aucccgcgccccccuccua

SEQ ID NO: 11287 - RNA, 19 nt, Artificial Sequence
  Description of Artificial Sequence: Synthetic oligonucleotide
ucccgcgccccccuccuca

SEQ ID NO: 11288 - RNA, 19 nt, Artificial Sequence
  Description of Artificial Sequence: Synthetic oligonucleotide
cccgcgccccccuccucaa

SEQ ID NO: 11289 - RNA, 19 nt, Artificial Sequence
  Description of Artificial Sequence: Synthetic oligonucleotide
ccgcgccccccuccucaca

SEQ ID NO: 11290 - RNA, 19 nt, Artificial Sequence
  Description of Artificial Sequence: Synthetic oligonucleotide
cgcgccccccuccucacua

SEQ ID NO: 11291 - RNA, 19 nt, Artificial Sequence
  Description of Artificial Sequence: Synthetic oligonucleotide
gcgccccccuccucacuua

SEQ ID NO: 11292 - RNA, 19 nt, Artificial Sequence
  Description of Artificial Sequence: Synthetic oligonucleotide
cgccccccuccucacuuga

SEQ ID NO: 11293 - RNA, 19 nt, Artificial Sequence
  Description of Artificial Sequence: Synthetic oligonucleotide
gccccccuccucacuugca

SEQ ID NO: 11294 - RNA, 19 nt, Artificial Sequence
  Description of Artificial Sequence: Synthetic oligonucleotide
ccccccuccucacuugcga

SEQ ID NO: 11295 - RNA, 19 nt, Artificial Sequence
  Description of Artificial Sequence: Synthetic oligonucleotide
cccccuccucacuugcgca

SEQ ID NO: 11296 - RNA, 19 nt, Artificial Sequence
  Description of Artificial Sequence: Synthetic oligonucleotide
ccccuccucacuugcgcua

SEQ ID NO: 11297 - RNA, 19 nt, Artificial Sequence
  Description of Artificial Sequence: Synthetic oligonucleotide
cccuccucacuugcgcuga

SEQ ID NO: 11298 - RNA, 19 nt, Artificial Sequence
  Description of Artificial Sequence: Synthetic oligonucleotide
ccuccucacuugcgcugca

SEQ ID NO: 11299 - RNA, 19 nt, Artificial Sequence
  Description of Artificial Sequence: Synthetic oligonucleotide
cuccucacuugcgcugcua

SEQ ID NO: 11300 - RNA, 19 nt, Artificial Sequence
  Description of Artificial Sequence: Synthetic oligonucleotide
uccucacuugcgcugcuca

SEQ ID NO: 11301 - RNA, 19 nt, Artificial Sequence
  Description of Artificial Sequence: Synthetic oligonucleotide
ccucacuugcgcugcucua

SEQ ID NO: 11302 - RNA, 19 nt, Artificial Sequence
  Description of Artificial Sequence: Synthetic oligonucleotide
cucacuugcgcugcucuca

SEQ ID NO: 11303 - RNA, 19 nt, Artificial Sequence
  Description of Artificial Sequence: Synthetic oligonucleotide
ucacuugcgcugcucucga

SEQ ID NO: 11304 - RNA, 19 nt, Artificial Sequence
  Description of Artificial Sequence: Synthetic oligonucleotide
cacuugcgcugcucucgga

SEQ ID NO: 11305 - RNA, 19 nt, Artificial Sequence
  Description of Artificial Sequence: Synthetic oligonucleotide
acuugcgcugcucucggaa

SEQ ID NO: 11306 - RNA, 19 nt, Artificial Sequence
  Description of Artificial Sequence: Synthetic oligonucleotide
cuugcgcugcucucggaga

SEQ ID NO: 11307 - RNA, 19 nt, Artificial Sequence
  Description of Artificial Sequence: Synthetic oligonucleotide
uugcgcugcucucggagca

SEQ ID NO: 11308 - RNA, 19 nt, Artificial Sequence
  Description of Artificial Sequence: Synthetic oligonucleotide
ugcgcugcucucggagcca

SEQ ID NO: 11309 - RNA, 19 nt, Artificial Sequence
  Description of Artificial Sequence: Synthetic oligonucleotide
gcgcugcucucggagccca

SEQ ID NO: 11310 - RNA, 19 nt, Artificial Sequence
  Description of Artificial Sequence: Synthetic oligonucleotide
cgcugcucucggagcccca

SEQ ID NO: 11311 - RNA, 19 nt, Artificial Sequence
  Description of Artificial Sequence: Synthetic oligonucleotide
gcugcucucggagccccaa

SEQ ID NO: 11312 - RNA, 19 nt, Artificial Sequence
  Description of Artificial Sequence: Synthetic oligonucleotide
cugcucucggagccccaga

SEQ ID NO: 11313 - RNA, 19 nt, Artificial Sequence
  Description of Artificial Sequence: Synthetic oligonucleotide
ugcucucggagccccagca

SEQ ID NO: 11314 - RNA, 19 nt, Artificial Sequence
  Description of Artificial Sequence: Synthetic oligonucleotide
gcucucggagccccagcca

SEQ ID NO: 11315 - RNA, 19 nt, Artificial Sequence
  Description of Artificial Sequence: Synthetic oligonucleotide
cucucggagccccagccga

SEQ ID NO: 11316 - RNA, 19 nt, Artificial Sequence
  Description of Artificial Sequence: Synthetic oligonucleotide
ucucggagccccagccgga

SEQ ID NO: 11317 - RNA, 19 nt, Artificial Sequence
  Description of Artificial Sequence: Synthetic oligonucleotide
cucggagccccagccggca

SEQ ID NO: 11318 - RNA, 19 nt, Artificial Sequence
  Description of Artificial Sequence: Synthetic oligonucleotide
ucggagccccagccggcua

SEQ ID NO: 11319 - RNA, 19 nt, Artificial Sequence
  Description of Artificial Sequence: Synthetic oligonucleotide
cggagccccagccggcuca

SEQ ID NO: 11320 - RNA, 19 nt, Artificial Sequence
  Description of Artificial Sequence: Synthetic oligonucleotide
ggagccccagccggcucca

SEQ ID NO: 11321 - RNA, 19 nt, Artificial Sequence
  Description of Artificial Sequence: Synthetic oligonucleotide
gagccccagccggcuccga

SEQ ID NO: 11322 - RNA, 19 nt, Artificial Sequence
  Description of Artificial Sequence: Synthetic oligonucleotide
agccccagccggcuccgca

SEQ ID NO: 11323 - RNA, 19 nt, Artificial Sequence
  Description of Artificial Sequence: Synthetic oligonucleotide
gccccagccggcuccgcca

SEQ ID NO: 11324 - RNA, 19 nt, Artificial Sequence
  Description of Artificial Sequence: Synthetic oligonucleotide
ccccagccggcuccgccca

SEQ ID NO: 11325 - RNA, 19 nt, Artificial Sequence
  Description of Artificial Sequence: Synthetic oligonucleotide
cccagccggcuccgcccga

SEQ ID NO: 11326 - RNA, 19 nt, Artificial Sequence
  Description of Artificial Sequence: Synthetic oligonucleotide
ccagccggcuccgcccgca

SEQ ID NO: 11327 - RNA, 19 nt, Artificial Sequence
  Description of Artificial Sequence: Synthetic oligonucleotide
cagccggcuccgcccgcua

SEQ ID NO: 11328 - RNA, 19 nt, Artificial Sequence
  Description of Artificial Sequence: Synthetic oligonucleotide
agccggcuccgcccgcuua

SEQ ID NO: 11329 - RNA, 19 nt, Artificial Sequence
  Description of Artificial Sequence: Synthetic oligonucleotide
gccggcuccgcccgcuuca

SEQ ID NO: 11330 - RNA, 19 nt, Artificial Sequence
  Description of Artificial Sequence: Synthetic oligonucleotide
ccggcuccgcccgcuucga

SEQ ID NO: 11331 - RNA, 19 nt, Artificial Sequence
  Description of Artificial Sequence: Synthetic oligonucleotide
cggcuccgcccgcuucgga

SEQ ID NO: 11332 - RNA, 19 nt, Artificial Sequence
  Description of Artificial Sequence: Synthetic oligonucleotide
ggcuccgcccgcuucggca

SEQ ID NO: 11333 - RNA, 19 nt, Artificial Sequence
  Description of Artificial Sequence: Synthetic oligonucleotide
gcuccgcccgcuucggcga

SEQ ID NO: 11334 - RNA, 19 nt, Artificial Sequence
  Description of Artificial Sequence: Synthetic oligonucleotide
cuccgcccgcuucggcgga

SEQ ID NO: 11335 - RNA, 19 nt, Artificial Sequence
  Description of Artificial Sequence: Synthetic oligonucleotide
uccgcccgcuucggcggua

SEQ ID NO: 11336 - RNA, 19 nt, Artificial Sequence
  Description of Artificial Sequence: Synthetic oligonucleotide
ccgcccgcuucggcgguua

SEQ ID NO: 11337 - RNA, 19 nt, Artificial Sequence
  Description of Artificial Sequence: Synthetic oligonucleotide
cgcccgcuucggcgguuua

SEQ ID NO: 11338 - RNA, 19 nt, Artificial Sequence
  Description of Artificial Sequence: Synthetic oligonucleotide
gcccgcuucggcgguuuga

SEQ ID NO: 11339 - RNA, 19 nt, Artificial Sequence
  Description of Artificial Sequence: Synthetic oligonucleotide
cccgcuucggcgguuugga

SEQ ID NO: 11340 - RNA, 19 nt, Artificial Sequence
  Description of Artificial Sequence: Synthetic oligonucleotide
ccgcuucggcgguuuggaa

SEQ ID NO: 11341 - RNA, 19 nt, Artificial Sequence
  Description of Artificial Sequence: Synthetic oligonucleotide
cgcuucggcgguuuggaua

SEQ ID NO: 11342 - RNA, 19 nt, Artificial Sequence
  Description of Artificial Sequence: Synthetic oligonucleotide
gcuucggcgguuuggauaa

SEQ ID NO: 11343 - RNA, 19 nt, Artificial Sequence
  Description of Artificial Sequence: Synthetic oligonucleotide
cuucggcgguuuggauaua

SEQ ID NO: 11344 - RNA, 19 nt, Artificial Sequence
  Description of Artificial Sequence: Synthetic oligonucleotide
uucggcgguuuggauauua

SEQ ID NO: 11345 - RNA, 19 nt, Artificial Sequence
  Description of Artificial Sequence: Synthetic oligonucleotide
ucggcgguuuggauauuua

SEQ ID NO: 11346 - RNA, 19 nt, Artificial Sequence
  Description of Artificial Sequence: Synthetic oligonucleotide
cggcgguuuggauauuuaa

SEQ ID NO: 11347 - RNA, 19 nt, Artificial Sequence
  Description of Artificial Sequence: Synthetic oligonucleotide
ggcgguuuggauauuuaua

SEQ ID NO: 11348 - RNA, 19 nt, Artificial Sequence
  Description of Artificial Sequence: Synthetic oligonucleotide
gcgguuuggauauuuauua

SEQ ID NO: 11349 - RNA, 19 nt, Artificial Sequence
  Description of Artificial Sequence: Synthetic oligonucleotide
cgguuuggauauuuauuga

SEQ ID NO: 11350 - RNA, 19 nt, Artificial Sequence
  Description of Artificial Sequence: Synthetic oligonucleotide
gguuuggauauuuauugaa

SEQ ID NO: 11351 - RNA, 19 nt, Artificial Sequence
  Description of Artificial Sequence: Synthetic oligonucleotide
guuuggauauuuauugaca

SEQ ID NO: 11352 - RNA, 19 nt, Artificial Sequence
  Description of Artificial Sequence: Synthetic oligonucleotide
uuuggauauuuauugacca

SEQ ID NO: 11353 - RNA, 19 nt, Artificial Sequence
  Description of Artificial Sequence: Synthetic oligonucleotide
uuggauauuuauugaccua

SEQ ID NO: 11354 - RNA, 19 nt, Artificial Sequence
  Description of Artificial Sequence: Synthetic oligonucleotide
uggauauuuauugaccuca

SEQ ID NO: 11355 - RNA, 19 nt, Artificial Sequence
  Description of Artificial Sequence: Synthetic oligonucleotide
ggauauuuauugaccucga

SEQ ID NO: 11356 - RNA, 19 nt, Artificial Sequence
  Description of Artificial Sequence: Synthetic oligonucleotide
gauauuuauugaccucgua

SEQ ID NO: 11357 - RNA, 19 nt, Artificial Sequence
  Description of Artificial Sequence: Synthetic oligonucleotide
auauuuauugaccucguca

SEQ ID NO: 11358 - RNA, 19 nt, Artificial Sequence
  Description of Artificial Sequence: Synthetic oligonucleotide
uauuuauugaccucgucca

SEQ ID NO: 11359 - RNA, 19 nt, Artificial Sequence
  Description of Artificial Sequence: Synthetic oligonucleotide
auuuauugaccucguccua

SEQ ID NO: 11360 - RNA, 19 nt, Artificial Sequence
  Description of Artificial Sequence: Synthetic oligonucleotide
uuuauugaccucguccuca

SEQ ID NO: 11361 - RNA, 19 nt, Artificial Sequence
  Description of Artificial Sequence: Synthetic oligonucleotide
uuauugaccucguccucca

SEQ ID NO: 11362 - RNA, 19 nt, Artificial Sequence
  Description of Artificial Sequence: Synthetic oligonucleotide
uauugaccucguccuccga

SEQ ID NO: 11363 - RNA, 19 nt, Artificial Sequence
  Description of Artificial Sequence: Synthetic oligonucleotide
auugaccucguccuccgaa

SEQ ID NO: 11364 - RNA, 19 nt, Artificial Sequence
  Description of Artificial Sequence: Synthetic oligonucleotide
uugaccucguccuccgaca

SEQ ID NO: 11365 - RNA, 19 nt, Artificial Sequence
  Description of Artificial Sequence: Synthetic oligonucleotide
ugaccucguccuccgacua

SEQ ID NO: 11366 - RNA, 19 nt, Artificial Sequence
  Description of Artificial Sequence: Synthetic oligonucleotide
gaccucguccuccgacuca

SEQ ID NO: 11367 - RNA, 19 nt, Artificial Sequence
  Description of Artificial Sequence: Synthetic oligonucleotide
accucguccuccgacucga

SEQ ID NO: 11368 - RNA, 19 nt, Artificial Sequence
  Description of Artificial Sequence: Synthetic oligonucleotide
ccucguccuccgacucgca

SEQ ID NO: 11369 - RNA, 19 nt, Artificial Sequence
  Description of Artificial Sequence: Synthetic oligonucleotide
cucguccuccgacucgcua

SEQ ID NO: 11370 - RNA, 19 nt, Artificial Sequence
  Description of Artificial Sequence: Synthetic oligonucleotide
ucguccuccgacucgcuga

SEQ ID NO: 11371 - RNA, 19 nt, Artificial Sequence
  Description of Artificial Sequence: Synthetic oligonucleotide
cguccuccgacucgcugaa

SEQ ID NO: 11372 - RNA, 19 nt, Artificial Sequence
  Description of Artificial Sequence: Synthetic oligonucleotide
guccuccgacucgcugaca

SEQ ID NO: 11373 - RNA, 19 nt, Artificial Sequence
  Description of Artificial Sequence: Synthetic oligonucleotide
uccuccgacucgcugacaa

SEQ ID NO: 11374 - RNA, 19 nt, Artificial Sequence
  Description of Artificial Sequence: Synthetic oligonucleotide
ccuccgacucgcugacaga

SEQ ID NO: 11375 - RNA, 19 nt, Artificial Sequence
  Description of Artificial Sequence: Synthetic oligonucleotide
cuccgacucgcugacagga

SEQ ID NO: 11376 - RNA, 19 nt, Artificial Sequence
  Description of Artificial Sequence: Synthetic oligonucleotide
uccgacucgcugacaggca

SEQ ID NO: 11377 - RNA, 19 nt, Artificial Sequence
  Description of Artificial Sequence: Synthetic oligonucleotide
ccgacucgcugacaggcua

SEQ ID NO: 11378 - RNA, 19 nt, Artificial Sequence
  Description of Artificial Sequence: Synthetic oligonucleotide
cgacucgcugacaggcuaa

SEQ ID NO: 11379 - RNA, 19 nt, Artificial Sequence
  Description of Artificial Sequence: Synthetic oligonucleotide
gacucgcugacaggcuaca

SEQ ID NO: 11380 - RNA, 19 nt, Artificial Sequence
  Description of Artificial Sequence: Synthetic oligonucleotide
acucgcugacaggcuacaa

SEQ ID NO: 11381 - RNA, 19 nt, Artificial Sequence
  Description of Artificial Sequence: Synthetic oligonucleotide
cucgcugacaggcuacaga

SEQ ID NO: 11382 - RNA, 19 nt, Artificial Sequence
  Description of Artificial Sequence: Synthetic oligonucleotide
ucgcugacaggcuacagga

SEQ ID NO: 11383 - RNA, 19 nt, Artificial Sequence
  Description of Artificial Sequence: Synthetic oligonucleotide
cgcugacaggcuacaggaa

SEQ ID NO: 11384 - RNA, 19 nt, Artificial Sequence
  Description of Artificial Sequence: Synthetic oligonucleotide
gcugacaggcuacaggaca

SEQ ID NO: 11385 - RNA, 19 nt, Artificial Sequence
  Description of Artificial Sequence: Synthetic oligonucleotide
cugacaggcuacaggacca

SEQ ID NO: 11386 - RNA, 19 nt, Artificial Sequence
  Description of Artificial Sequence: Synthetic oligonucleotide
ugacaggcuacaggaccca

SEQ ID NO: 11387 - RNA, 19 nt, Artificial Sequence
  Description of Artificial Sequence: Synthetic oligonucleotide
gacaggcuacaggacccca

SEQ ID NO: 11388 - RNA, 19 nt, Artificial Sequence
  Description of Artificial Sequence: Synthetic oligonucleotide
acaggcuacaggaccccca

SEQ ID NO: 11389 - RNA, 19 nt, Artificial Sequence
  Description of Artificial Sequence: Synthetic oligonucleotide
caggcuacaggacccccaa

SEQ ID NO: 11390 - RNA, 19 nt, Artificial Sequence
  Description of Artificial Sequence: Synthetic oligonucleotide
aggcuacaggacccccaaa

SEQ ID NO: 11391 - RNA, 19 nt, Artificial Sequence
  Description of Artificial Sequence: Synthetic oligonucleotide
ggcuacaggacccccaaca

SEQ ID NO: 11392 - RNA, 19 nt, Artificial Sequence
  Description of Artificial Sequence: Synthetic oligonucleotide
gcuacaggacccccaacaa

SEQ ID NO: 11393 - RNA, 19 nt, Artificial Sequence
  Description of Artificial Sequence: Synthetic oligonucleotide
cuacaggacccccaacaaa

SEQ ID NO: 11394 - RNA, 19 nt, Artificial Sequence
  Description of Artificial Sequence: Synthetic oligonucleotide
uacaggacccccaacaaca

SEQ ID NO: 11395 - RNA, 19 nt, Artificial Sequence
  Description of Artificial Sequence: Synthetic oligonucleotide
acaggacccccaacaacca

SEQ ID NO: 11396 - RNA, 19 nt, Artificial Sequence
  Description of Artificial Sequence: Synthetic oligonucleotide
caggacccccaacaaccca

SEQ ID NO: 11397 - RNA, 19 nt, Artificial Sequence
  Description of Artificial Sequence: Synthetic oligonucleotide
aggacccccaacaacccca

SEQ ID NO: 11398 - RNA, 19 nt, Artificial Sequence
  Description of Artificial Sequence: Synthetic oligonucleotide
ggacccccaacaaccccaa

SEQ ID NO: 11399 - RNA, 19 nt, Artificial Sequence
  Description of Artificial Sequence: Synthetic oligonucleotide
gacccccaacaaccccaaa

SEQ ID NO: 11400 - RNA, 19 nt, Artificial Sequence
  Description of Artificial Sequence: Synthetic oligonucleotide
acccccaacaaccccaaua

SEQ ID NO: 11401 - RNA, 19 nt, Artificial Sequence
  Description of Artificial Sequence: Synthetic oligonucleotide
cccccaacaaccccaauca

SEQ ID NO: 11402 - RNA, 19 nt, Artificial Sequence
  Description of Artificial Sequence: Synthetic oligonucleotide
ccccaacaaccccaaucca

SEQ ID NO: 11403 - RNA, 19 nt, Artificial Sequence
  Description of Artificial Sequence: Synthetic oligonucleotide
cccaacaaccccaauccaa

SEQ ID NO: 11404 - RNA, 19 nt, Artificial Sequence
  Description of Artificial Sequence: Synthetic oligonucleotide
ccaacaaccccaauccaca

SEQ ID NO: 11405 - RNA, 19 nt, Artificial Sequence
  Description of Artificial Sequence: Synthetic oligonucleotide
caacaaccccaauccacga

SEQ ID NO: 11406 - RNA, 19 nt, Artificial Sequence
  Description of Artificial Sequence: Synthetic oligonucleotide
aacaaccccaauccacgua

SEQ ID NO: 11407 - RNA, 19 nt, Artificial Sequence
  Description of Artificial Sequence: Synthetic oligonucleotide
acaaccccaauccacguua

SEQ ID NO: 11408 - RNA, 19 nt, Artificial Sequence
  Description of Artificial Sequence: Synthetic oligonucleotide
caaccccaauccacguuua

SEQ ID NO: 11409 - RNA, 19 nt, Artificial Sequence
  Description of Artificial Sequence: Synthetic oligonucleotide
aaccccaauccacguuuua

SEQ ID NO: 11410 - RNA, 19 nt, Artificial Sequence
  Description of Artificial Sequence: Synthetic oligonucleotide
accccaauccacguuuuga

SEQ ID NO: 11411 - RNA, 19 nt, Artificial Sequence
  Description of Artificial Sequence: Synthetic oligonucleotide
ccccaauccacguuuugga

SEQ ID NO: 11412 - RNA, 19 nt, Artificial Sequence
  Description of Artificial Sequence: Synthetic oligonucleotide
cccaauccacguuuuggaa

SEQ ID NO: 11413 - RNA, 19 nt, Artificial Sequence
  Description of Artificial Sequence: Synthetic oligonucleotide
ccaauccacguuuuggaua

SEQ ID NO: 11414 - RNA, 19 nt, Artificial Sequence
  Description of Artificial Sequence: Synthetic oligonucleotide
caauccacguuuuggauga

SEQ ID NO: 11415 - RNA, 19 nt, Artificial Sequence
  Description of Artificial Sequence: Synthetic oligonucleotide
aauccacguuuuggaugca

SEQ ID NO: 11416 - RNA, 19 nt, Artificial Sequence
  Description of Artificial Sequence: Synthetic oligonucleotide
auccacguuuuggaugcaa

SEQ ID NO: 11417 - RNA, 19 nt, Artificial Sequence
  Description of Artificial Sequence: Synthetic oligonucleotide
uccacguuuuggaugcaca

SEQ ID NO: 11418 - RNA, 19 nt, Artificial Sequence
  Description of Artificial Sequence: Synthetic oligonucleotide
ccacguuuuggaugcacua

SEQ ID NO: 11419 - RNA, 19 nt, Artificial Sequence
  Description of Artificial Sequence: Synthetic oligonucleotide
cacguuuuggaugcacuga

SEQ ID NO: 11420 - RNA, 19 nt, Artificial Sequence
  Description of Artificial Sequence: Synthetic oligonucleotide
acguuuuggaugcacugaa

SEQ ID NO: 11421 - RNA, 19 nt, Artificial Sequence
  Description of Artificial Sequence: Synthetic oligonucleotide
cguuuuggaugcacugaga

SEQ ID NO: 11422 - RNA, 19 nt, Artificial Sequence
  Description of Artificial Sequence: Synthetic oligonucleotide
guuuuggaugcacugagaa

SEQ ID NO: 11423 - RNA, 19 nt, Artificial Sequence
  Description of Artificial Sequence: Synthetic oligonucleotide
uuuuggaugcacugagaca

SEQ ID NO: 11424 - RNA, 19 nt, Artificial Sequence
  Description of Artificial Sequence: Synthetic oligonucleotide
uuuggaugcacugagacca

SEQ ID NO: 11425 - RNA, 19 nt, Artificial Sequence
  Description of Artificial Sequence: Synthetic oligonucleotide
uuggaugcacugagaccca

SEQ ID NO: 11426 - RNA, 19 nt, Artificial Sequence
  Description of Artificial Sequence: Synthetic oligonucleotide
uggaugcacugagacccca

SEQ ID NO: 11427 - RNA, 19 nt, Artificial Sequence
  Description of Artificial Sequence: Synthetic oligonucleotide
ggaugcacugagaccccga

SEQ ID NO: 11428 - RNA, 19 nt, Artificial Sequence
  Description of Artificial Sequence: Synthetic oligonucleotide
gaugcacugagaccccgaa

SEQ ID NO: 11429 - RNA, 19 nt, Artificial Sequence
  Description of Artificial Sequence: Synthetic oligonucleotide
augcacugagaccccgaca

SEQ ID NO: 11430 - RNA, 19 nt, Artificial Sequence
  Description of Artificial Sequence: Synthetic oligonucleotide
ugcacugagaccccgacaa

SEQ ID NO: 11431 - RNA, 19 nt, Artificial Sequence
  Description of Artificial Sequence: Synthetic oligonucleotide
gcacugagaccccgacaua

SEQ ID NO: 11432 - RNA, 19 nt, Artificial Sequence
  Description of Artificial Sequence: Synthetic oligonucleotide
cacugagaccccgacauua

SEQ ID NO: 11433 - RNA, 19 nt, Artificial Sequence
  Description of Artificial Sequence: Synthetic oligonucleotide
acugagaccccgacauuca

SEQ ID NO: 11434 - RNA, 19 nt, Artificial Sequence
  Description of Artificial Sequence: Synthetic oligonucleotide
cugagaccccgacauucca

SEQ ID NO: 11435 - RNA, 19 nt, Artificial Sequence
  Description of Artificial Sequence: Synthetic oligonucleotide
ugagaccccgacauuccua

SEQ ID NO: 11436 - RNA, 19 nt, Artificial Sequence
  Description of Artificial Sequence: Synthetic oligonucleotide
gagaccccgacauuccuca

SEQ ID NO: 11437 - RNA, 19 nt, Artificial Sequence
  Description of Artificial Sequence: Synthetic oligonucleotide
agaccccgacauuccucga

SEQ ID NO: 11438 - RNA, 19 nt, Artificial Sequence
  Description of Artificial Sequence: Synthetic oligonucleotide
gaccccgacauuccucgga

SEQ ID NO: 11439 - RNA, 19 nt, Artificial Sequence
  Description of Artificial Sequence: Synthetic oligonucleotide
accccgacauuccucggua

SEQ ID NO: 11440 - RNA, 19 nt, Artificial Sequence
  Description of Artificial Sequence: Synthetic oligonucleotide
ccccgacauuccucgguaa

SEQ ID NO: 11441 - RNA, 19 nt, Artificial Sequence
  Description of Artificial Sequence: Synthetic oligonucleotide
cccgacauuccucgguaua

SEQ ID NO: 11442 - RNA, 19 nt, Artificial Sequence
  Description of Artificial Sequence: Synthetic oligonucleotide
ccgacauuccucgguauua

SEQ ID NO: 11443 - RNA, 19 nt, Artificial Sequence
  Description of Artificial Sequence: Synthetic oligonucleotide
cgacauuccucgguauuua

SEQ ID NO: 11444 - RNA, 19 nt, Artificial Sequence
  Description of Artificial Sequence: Synthetic oligonucleotide
gacauuccucgguauuuaa

SEQ ID NO: 11445 - RNA, 19 nt, Artificial Sequence
  Description of Artificial Sequence: Synthetic oligonucleotide
acauuccucgguauuuaua

SEQ ID NO: 11446 - RNA, 19 nt, Artificial Sequence
  Description of Artificial Sequence: Synthetic oligonucleotide
cauuccucgguauuuauua

SEQ ID NO: 11447 - RNA, 19 nt, Artificial Sequence
  Description of Artificial Sequence: Synthetic oligonucleotide
auuccucgguauuuauuga

SEQ ID NO: 11448 - RNA, 19 nt, Artificial Sequence
  Description of Artificial Sequence: Synthetic oligonucleotide
uuccucgguauuuauugua

SEQ ID NO: 11449 - RNA, 19 nt, Artificial Sequence
  Description of Artificial Sequence: Synthetic oligonucleotide
uccucgguauuuauuguca

SEQ ID NO: 11450 - RNA, 19 nt, Artificial Sequence
  Description of Artificial Sequence: Synthetic oligonucleotide
ccucgguauuuauugucua

SEQ ID NO: 11451 - RNA, 19 nt, Artificial Sequence
  Description of Artificial Sequence: Synthetic oligonucleotide
cucgguauuuauugucuga

SEQ ID NO: 11452 - RNA, 19 nt, Artificial Sequence
  Description of Artificial Sequence: Synthetic oligonucleotide
ucgguauuuauugucugua

SEQ ID NO: 11453 - RNA, 19 nt, Artificial Sequence
  Description of Artificial Sequence: Synthetic oligonucleotide
cgguauuuauugucuguca

SEQ ID NO: 11454 - RNA, 19 nt, Artificial Sequence
  Description of Artificial Sequence: Synthetic oligonucleotide
gguauuuauugucugucca

SEQ ID NO: 11455 - RNA, 19 nt, Artificial Sequence
  Description of Artificial Sequence: Synthetic oligonucleotide
guauuuauugucuguccca

SEQ ID NO: 11456 - RNA, 19 nt, Artificial Sequence
  Description of Artificial Sequence: Synthetic oligonucleotide
uauuuauugucugucccca

SEQ ID NO: 11457 - RNA, 19 nt, Artificial Sequence
  Description of Artificial Sequence: Synthetic oligonucleotide
auuuauugucuguccccaa

SEQ ID NO: 11458 - RNA, 19 nt, Artificial Sequence
  Description of Artificial Sequence: Synthetic oligonucleotide
uuuauugucuguccccaca

SEQ ID NO: 11459 - RNA, 19 nt, Artificial Sequence
  Description of Artificial Sequence: Synthetic oligonucleotide
uuauugucuguccccacca

SEQ ID NO: 11460 - RNA, 19 nt, Artificial Sequence
  Description of Artificial Sequence: Synthetic oligonucleotide
uauugucuguccccaccua

SEQ ID NO: 11461 - RNA, 19 nt, Artificial Sequence
  Description of Artificial Sequence: Synthetic oligonucleotide
auugucuguccccaccuaa

SEQ ID NO: 11462 - RNA, 19 nt, Artificial Sequence
  Description of Artificial Sequence: Synthetic oligonucleotide
uugucuguccccaccuaga

SEQ ID NO: 11463 - RNA, 19 nt, Artificial Sequence
  Description of Artificial Sequence: Synthetic oligonucleotide
ugucuguccccaccuagga

SEQ ID NO: 11464 - RNA, 19 nt, Artificial Sequence
  Description of Artificial Sequence: Synthetic oligonucleotide
gucuguccccaccuaggaa

SEQ ID NO: 11465 - RNA, 19 nt, Artificial Sequence
  Description of Artificial Sequence: Synthetic oligonucleotide
ucuguccccaccuaggaca

SEQ ID NO: 11466 - RNA, 19 nt, Artificial Sequence
  Description of Artificial Sequence: Synthetic oligonucleotide
cuguccccaccuaggacca

SEQ ID NO: 11467 - RNA, 19 nt, Artificial Sequence
  Description of Artificial Sequence: Synthetic oligonucleotide
uguccccaccuaggaccca

SEQ ID NO: 11468 - RNA, 19 nt, Artificial Sequence
  Description of Artificial Sequence: Synthetic oligonucleotide
guccccaccuaggacccca

SEQ ID NO: 11469 - RNA, 19 nt, Artificial Sequence
  Description of Artificial Sequence: Synthetic oligonucleotide
uccccaccuaggaccccca

SEQ ID NO: 11470 - RNA, 19 nt, Artificial Sequence
  Description of Artificial Sequence: Synthetic oligonucleotide
ccccaccuaggacccccaa

SEQ ID NO: 11471 - RNA, 19 nt, Artificial Sequence
  Description of Artificial Sequence: Synthetic oligonucleotide
cccaccuaggacccccaca

SEQ ID NO: 11472 - RNA, 19 nt, Artificial Sequence
  Description of Artificial Sequence: Synthetic oligonucleotide
ccaccuaggacccccacca

SEQ ID NO: 11473 - RNA, 19 nt, Artificial Sequence
  Description of Artificial Sequence: Synthetic oligonucleotide
caccuaggacccccaccca

SEQ ID NO: 11474 - RNA, 19 nt, Artificial Sequence
  Description of Artificial Sequence: Synthetic oligonucleotide
accuaggacccccacccca

SEQ ID NO: 11475 - RNA, 19 nt, Artificial Sequence
  Description of Artificial Sequence: Synthetic oligonucleotide
ccuaggacccccaccccca

SEQ ID NO: 11476 - RNA, 19 nt, Artificial Sequence
  Description of Artificial Sequence: Synthetic oligonucleotide
cuaggacccccacccccga

SEQ ID NO: 11477 - RNA, 19 nt, Artificial Sequence
  Description of Artificial Sequence: Synthetic oligonucleotide
uaggacccccacccccgaa

SEQ ID NO: 11478 - RNA, 19 nt, Artificial Sequence
  Description of Artificial Sequence: Synthetic oligonucleotide
aggacccccacccccgaca

SEQ ID NO: 11479 - RNA, 19 nt, Artificial Sequence
  Description of Artificial Sequence: Synthetic oligonucleotide
ggacccccacccccgacca

SEQ ID NO: 11480 - RNA, 19 nt, Artificial Sequence
  Description of Artificial Sequence: Synthetic oligonucleotide
gacccccacccccgaccca

SEQ ID NO: 11481 - RNA, 19 nt, Artificial Sequence
  Description of Artificial Sequence: Synthetic oligonucleotide
acccccacccccgacccua

SEQ ID NO: 11482 - RNA, 19 nt, Artificial Sequence
  Description of Artificial Sequence: Synthetic oligonucleotide
cccccacccccgacccuca

SEQ ID NO: 11483 - RNA, 19 nt, Artificial Sequence
  Description of Artificial Sequence: Synthetic oligonucleotide
ccccacccccgacccucga

SEQ ID NO: 11484 - RNA, 19 nt, Artificial Sequence
  Description of Artificial Sequence: Synthetic oligonucleotide
cccacccccgacccucgca

SEQ ID NO: 11485 - RNA, 19 nt, Artificial Sequence
  Description of Artificial Sequence: Synthetic oligonucleotide
ccacccccgacccucgcga

SEQ ID NO: 11486 - RNA, 19 nt, Artificial Sequence
  Description of Artificial Sequence: Synthetic oligonucleotide
cacccccgacccucgcgaa

SEQ ID NO: 11487 - RNA, 19 nt, Artificial Sequence
  Description of Artificial Sequence: Synthetic oligonucleotide
acccccgacccucgcgaaa

SEQ ID NO: 11488 - RNA, 19 nt, Artificial Sequence
  Description of Artificial Sequence: Synthetic oligonucleotide
cccccgacccucgcgaaua

SEQ ID NO: 11489 - RNA, 19 nt, Artificial Sequence
  Description of Artificial Sequence: Synthetic oligonucleotide
ccccgacccucgcgaauaa

SEQ ID NO: 11490 - RNA, 19 nt, Artificial Sequence
  Description of Artificial Sequence: Synthetic oligonucleotide
cccgacccucgcgaauaaa

SEQ ID NO: 11491 - RNA, 19 nt, Artificial Sequence
  Description of Artificial Sequence: Synthetic oligonucleotide
ccgacccucgcgaauaaaa

SEQ ID NO: 11492 - RNA, 19 nt, Artificial Sequence
  Description of Artificial Sequence: Synthetic oligonucleotide
cgacccucgcgaauaaaaa

SEQ ID NO: 11493 - RNA, 19 nt, Artificial Sequence
  Description of Artificial Sequence: Synthetic oligonucleotide
gacccucgcgaauaaaaga

SEQ ID NO: 11494 - RNA, 19 nt, Artificial Sequence
  Description of Artificial Sequence: Synthetic oligonucleotide
acccucgcgaauaaaagga

SEQ ID NO: 11495 - RNA, 19 nt, Artificial Sequence
  Description of Artificial Sequence: Synthetic oligonucleotide
cccucgcgaauaaaaggca

SEQ ID NO: 11496 - RNA, 19 nt, Artificial Sequence
  Description of Artificial Sequence: Synthetic oligonucleotide
ccucgcgaauaaaaggcca

SEQ ID NO: 11497 - RNA, 19 nt, Artificial Sequence
  Description of Artificial Sequence: Synthetic oligonucleotide
cucgcgaauaaaaggccca

SEQ ID NO: 11498 - RNA, 19 nt, Artificial Sequence
  Description of Artificial Sequence: Synthetic oligonucleotide
ucgcgaauaaaaggcccua

SEQ ID NO: 11499 - RNA, 19 nt, Artificial Sequence
  Description of Artificial Sequence: Synthetic oligonucleotide
cgcgaauaaaaggcccuca

SEQ ID NO: 11500 - RNA, 19 nt, Artificial Sequence
  Description of Artificial Sequence: Synthetic oligonucleotide
gcgaauaaaaggcccucca

SEQ ID NO: 11501 - RNA, 19 nt, Artificial Sequence
  Description of Artificial Sequence: Synthetic oligonucleotide
cgaauaaaaggcccuccaa

SEQ ID NO: 11502 - RNA, 19 nt, Artificial Sequence
  Description of Artificial Sequence: Synthetic oligonucleotide
gaauaaaaggcccuccaua

SEQ ID NO: 11503 - RNA, 19 nt, Artificial Sequence
  Description of Artificial Sequence: Synthetic oligonucleotide
aauaaaaggcccuccauca

SEQ ID NO: 11504 - RNA, 19 nt, Artificial Sequence
  Description of Artificial Sequence: Synthetic oligonucleotide
auaaaaggcccuccaucua

SEQ ID NO: 11505 - RNA, 19 nt, Artificial Sequence
  Description of Artificial Sequence: Synthetic oligonucleotide
uaaaaggcccuccaucuga

SEQ ID NO: 11506 - RNA, 19 nt, Artificial Sequence
  Description of Artificial Sequence: Synthetic oligonucleotide
aaaaggcccuccaucugca

SEQ ID NO: 11507 - RNA, 19 nt, Artificial Sequence
  Description of Artificial Sequence: Synthetic oligonucleotide
aaaggcccuccaucugcca

SEQ ID NO: 11508 - RNA, 19 nt, Artificial Sequence
  Description of Artificial Sequence: Synthetic oligonucleotide
aaggcccuccaucugccca

SEQ ID NO: 11509 - RNA, 19 nt, Artificial Sequence
  Description of Artificial Sequence: Synthetic oligonucleotide
aggcccuccaucugcccaa

SEQ ID NO: 11510 - RNA, 19 nt, Artificial Sequence
  Description of Artificial Sequence: Synthetic oligonucleotide
ggcccuccaucugcccaaa

SEQ ID NO: 11511 - RNA, 19 nt, Artificial Sequence
  Description of Artificial Sequence: Synthetic oligonucleotide
gcccuccaucugcccaaaa

SEQ ID NO: 11512 - RNA, 19 nt, Artificial Sequence
  Description of Artificial Sequence: Synthetic oligonucleotide
cccuccaucugcccaaaga

SEQ ID NO: 11513 - RNA, 19 nt, Artificial Sequence
  Description of Artificial Sequence: Synthetic oligonucleotide
ccuccaucugcccaaagca

SEQ ID NO: 11514 - RNA, 19 nt, Artificial Sequence
  Description of Artificial Sequence: Synthetic oligonucleotide
cuccaucugcccaaagcua

SEQ ID NO: 11515 - RNA, 19 nt, Artificial Sequence
  Description of Artificial Sequence: Synthetic oligonucleotide
uccaucugcccaaagcuca

SEQ ID NO: 11516 - RNA, 19 nt, Artificial Sequence
  Description of Artificial Sequence: Synthetic oligonucleotide
ccaucugcccaaagcucua

SEQ ID NO: 11517 - RNA, 19 nt, Artificial Sequence
  Description of Artificial Sequence: Synthetic oligonucleotide
caucugcccaaagcucuga

SEQ ID NO: 11518 - RNA, 19 nt, Artificial Sequence
  Description of Artificial Sequence: Synthetic oligonucleotide
aucugcccaaagcucugga

SEQ ID NO: 11519 - RNA, 19 nt, Artificial Sequence
  Description of Artificial Sequence: Synthetic oligonucleotide
uccuugguccagccccccu

SEQ ID NO: 11520 - RNA, 19 nt, Artificial Sequence
  Description of Artificial Sequence: Synthetic oligonucleotide
ucccuugguccagcccccc

SEQ ID NO: 11521 - RNA, 19 nt, Artificial Sequence
  Description of Artificial Sequence: Synthetic oligonucleotide
uccccuugguccagccccc

SEQ ID NO: 11522 - RNA, 19 nt, Artificial Sequence
  Description of Artificial Sequence: Synthetic oligonucleotide
uaccccuugguccagcccc

SEQ ID NO: 11523 - RNA, 19 nt, Artificial Sequence
  Description of Artificial Sequence: Synthetic oligonucleotide
ucaccccuugguccagccc

SEQ ID NO: 11524 - RNA, 19 nt, Artificial Sequence
  Description of Artificial Sequence: Synthetic oligonucleotide
uccaccccuugguccagcc

SEQ ID NO: 11525 - RNA, 19 nt, Artificial Sequence
  Description of Artificial Sequence: Synthetic oligonucleotide
ucccaccccuugguccagc

SEQ ID NO: 11526 - RNA, 19 nt, Artificial Sequence
  Description of Artificial Sequence: Synthetic oligonucleotide
uccccaccccuugguccag

SEQ ID NO: 11527 - RNA, 19 nt, Artificial Sequence
  Description of Artificial Sequence: Synthetic oligonucleotide
uuccccaccccuuggucca

SEQ ID NO: 11528 - RNA, 19 nt, Artificial Sequence
  Description of Artificial Sequence: Synthetic oligonucleotide
ucuccccaccccuuggucc

SEQ ID NO: 11529 - RNA, 19 nt, Artificial Sequence
  Description of Artificial Sequence: Synthetic oligonucleotide
uucuccccaccccuugguc

SEQ ID NO: 11530 - RNA, 19 nt, Artificial Sequence
  Description of Artificial Sequence: Synthetic oligonucleotide
uuucuccccaccccuuggu

SEQ ID NO: 11531 - RNA, 19 nt, Artificial Sequence
  Description of Artificial Sequence: Synthetic oligonucleotide
ucuucuccccaccccuugg

SEQ ID NO: 11532 - RNA, 19 nt, Artificial Sequence
  Description of Artificial Sequence: Synthetic oligonucleotide
uccuucuccccaccccuug

SEQ ID NO: 11533 - RNA, 19 nt, Artificial Sequence
  Description of Artificial Sequence: Synthetic oligonucleotide
ucccuucuccccaccccuu

SEQ ID NO: 11534 - RNA, 19 nt, Artificial Sequence
  Description of Artificial Sequence: Synthetic oligonucleotide
uccccuucuccccaccccu

SEQ ID NO: 11535 - RNA, 19 nt, Artificial Sequence
  Description of Artificial Sequence: Synthetic oligonucleotide
uuccccuucuccccacccc

SEQ ID NO: 11536 - RNA, 19 nt, Artificial Sequence
  Description of Artificial Sequence: Synthetic oligonucleotide
ucuccccuucuccccaccc

SEQ ID NO: 11537 - RNA, 19 nt, Artificial Sequence
  Description of Artificial Sequence: Synthetic oligonucleotide
uccuccccuucuccccacc

SEQ ID NO: 11538 - RNA, 19 nt, Artificial Sequence
  Description of Artificial Sequence: Synthetic oligonucleotide
uuccuccccuucuccccac

SEQ ID NO: 11539 - RNA, 19 nt, Artificial Sequence
  Description of Artificial Sequence: Synthetic oligonucleotide
ucuccuccccuucucccca

SEQ ID NO: 11540 - RNA, 19 nt, Artificial Sequence
  Description of Artificial Sequence: Synthetic oligonucleotide
uccuccuccccuucucccc

SEQ ID NO: 11541 - RNA, 19 nt, Artificial Sequence
  Description of Artificial Sequence: Synthetic oligonucleotide
ugccuccuccccuucuccc

SEQ ID NO: 11542 - RNA, 19 nt, Artificial Sequence
  Description of Artificial Sequence: Synthetic oligonucleotide
uggccuccuccccuucucc

SEQ ID NO: 11543 - RNA, 19 nt, Artificial Sequence
  Description of Artificial Sequence: Synthetic oligonucleotide
uaggccuccuccccuucuc

SEQ ID NO: 11544 - RNA, 19 nt, Artificial Sequence
  Description of Artificial Sequence: Synthetic oligonucleotide
ugaggccuccuccccuucu

SEQ ID NO: 11545 - RNA, 19 nt, Artificial Sequence
  Description of Artificial Sequence: Synthetic oligonucleotide
ucgaggccuccuccccuuc

SEQ ID NO: 11546 - RNA, 19 nt, Artificial Sequence
  Description of Artificial Sequence: Synthetic oligonucleotide
uccgaggccuccuccccuu

SEQ ID NO: 11547 - RNA, 19 nt, Artificial Sequence
  Description of Artificial Sequence: Synthetic oligonucleotide
ugccgaggccuccuccccu

SEQ ID NO: 11548 - RNA, 19 nt, Artificial Sequence
  Description of Artificial Sequence: Synthetic oligonucleotide
uggccgaggccuccucccc

SEQ ID NO: 11549 - RNA, 19 nt, Artificial Sequence
  Description of Artificial Sequence: Synthetic oligonucleotide
ucggccgaggccuccuccc

SEQ ID NO: 11550 - RNA, 19 nt, Artificial Sequence
  Description of Artificial Sequence: Synthetic oligonucleotide
uccggccgaggccuccucc

SEQ ID NO: 11551 - RNA, 19 nt, Artificial Sequence
  Description of Artificial Sequence: Synthetic oligonucleotide
ugccggccgaggccuccuc

SEQ ID NO: 11552 - RNA, 19 nt, Artificial Sequence
  Description of Artificial Sequence: Synthetic oligonucleotide
uggccggccgaggccuccu

SEQ ID NO: 11553 - RNA, 19 nt, Artificial Sequence
  Description of Artificial Sequence: Synthetic oligonucleotide
ucggccggccgaggccucc

SEQ ID NO: 11554 - RNA, 19 nt, Artificial Sequence
  Description of Artificial Sequence: Synthetic oligonucleotide
ugcggccggccgaggccuc

SEQ ID NO: 11555 - RNA, 19 nt, Artificial Sequence
  Description of Artificial Sequence: Synthetic oligonucleotide
uugcggccggccgaggccu

SEQ ID NO: 11556 - RNA, 19 nt, Artificial Sequence
  Description of Artificial Sequence: Synthetic oligonucleotide
ucugcggccggccgaggcc

SEQ ID NO: 11557 - RNA, 19 nt, Artificial Sequence
  Description of Artificial Sequence: Synthetic oligonucleotide
uucugcggccggccgaggc

SEQ ID NO: 11558 - RNA, 19 nt, Artificial Sequence
  Description of Artificial Sequence: Synthetic oligonucleotide
ucucugcggccggccgagg

SEQ ID NO: 11559 - RNA, 19 nt, Artificial Sequence
  Description of Artificial Sequence: Synthetic oligonucleotide
uucucugcggccggccgag

SEQ ID NO: 11560 - RNA, 19 nt, Artificial Sequence
  Description of Artificial Sequence: Synthetic oligonucleotide
ucucucugcggccggccga

SEQ ID NO: 11561 - RNA, 19 nt, Artificial Sequence
  Description of Artificial Sequence: Synthetic oligonucleotide
uucucucugcggccggccg

SEQ ID NO: 11562 - RNA, 19 nt, Artificial Sequence
  Description of Artificial Sequence: Synthetic oligonucleotide
uuucucucugcggccggcc

SEQ ID NO: 11563 - RNA, 19 nt, Artificial Sequence
  Description of Artificial Sequence: Synthetic oligonucleotide
ucuucucucugcggccggc

SEQ ID NO: 11564 - RNA, 19 nt, Artificial Sequence
  Description of Artificial Sequence: Synthetic oligonucleotide
uacuucucucugcggccgg

SEQ ID NO: 11565 - RNA, 19 nt, Artificial Sequence
  Description of Artificial Sequence: Synthetic oligonucleotide
ucacuucucucugcggccg

SEQ ID NO: 11566 - RNA, 19 nt, Artificial Sequence
  Description of Artificial Sequence: Synthetic oligonucleotide
uccacuucucucugcggcc

SEQ ID NO: 11567 - RNA, 19 nt, Artificial Sequence
  Description of Artificial Sequence: Synthetic oligonucleotide
ugccacuucucucugcggc

SEQ ID NO: 11568 - RNA, 19 nt, Artificial Sequence
  Description of Artificial Sequence: Synthetic oligonucleotide
uggccacuucucucugcgg

SEQ ID NO: 11569 - RNA, 19 nt, Artificial Sequence
  Description of Artificial Sequence: Synthetic oligonucleotide
uuggccacuucucucugcg

SEQ ID NO: 11570 - RNA, 19 nt, Artificial Sequence
  Description of Artificial Sequence: Synthetic oligonucleotide
ucuggccacuucucucugc

SEQ ID NO: 11571 - RNA, 19 nt, Artificial Sequence
  Description of Artificial Sequence: Synthetic oligonucleotide
uucuggccacuucucucug

SEQ ID NO: 11572 - RNA, 19 nt, Artificial Sequence
  Description of Artificial Sequence: Synthetic oligonucleotide
ucucuggccacuucucucu

SEQ ID NO: 11573 - RNA, 19 nt, Artificial Sequence
  Description of Artificial Sequence: Synthetic oligonucleotide
uucucuggccacuucucuc

SEQ ID NO: 11574 - RNA, 19 nt, Artificial Sequence
  Description of Artificial Sequence: Synthetic oligonucleotide
ucucucuggccacuucucu

SEQ ID NO: 11575 - RNA, 19 nt, Artificial Sequence
  Description of Artificial Sequence: Synthetic oligonucleotide
uccucucuggccacuucuc

SEQ ID NO: 11576 - RNA, 19 nt, Artificial Sequence
  Description of Artificial Sequence: Synthetic oligonucleotide
ugccucucuggccacuucu

SEQ ID NO: 11577 - RNA, 19 nt, Artificial Sequence
  Description of Artificial Sequence: Synthetic oligonucleotide
uggccucucuggccacuuc

SEQ ID NO: 11578 - RNA, 19 nt, Artificial Sequence
  Description of Artificial Sequence: Synthetic oligonucleotide
ugggccucucuggccacuu

SEQ ID NO: 11579 - RNA, 19 nt, Artificial Sequence
  Description of Artificial Sequence: Synthetic oligonucleotide
uugggccucucuggccacu

SEQ ID NO: 11580 - RNA, 19 nt, Artificial Sequence
  Description of Artificial Sequence: Synthetic oligonucleotide
ucugggccucucuggccac

SEQ ID NO: 11581 - RNA, 19 nt, Artificial Sequence
  Description of Artificial Sequence: Synthetic oligonucleotide
uccugggccucucuggcca

SEQ ID NO: 11582 - RNA, 19 nt, Artificial Sequence
  Description of Artificial Sequence: Synthetic oligonucleotide
ucccugggccucucuggcc

SEQ ID NO: 11583 - RNA, 19 nt, Artificial Sequence
  Description of Artificial Sequence: Synthetic oligonucleotide
uccccugggccucucuggc

SEQ ID NO: 11584 - RNA, 19 nt, Artificial Sequence
  Description of Artificial Sequence: Synthetic oligonucleotide
uuccccugggccucucugg

SEQ ID NO: 11585 - RNA, 19 nt, Artificial Sequence
  Description of Artificial Sequence: Synthetic oligonucleotide
uguccccugggccucucug

SEQ ID NO: 11586 - RNA, 19 nt, Artificial Sequence
  Description of Artificial Sequence: Synthetic oligonucleotide
uuguccccugggccucucu

SEQ ID NO: 11587 - RNA, 19 nt, Artificial Sequence
  Description of Artificial Sequence: Synthetic oligonucleotide
ucuguccccugggccucuc

SEQ ID NO: 11588 - RNA, 19 nt, Artificial Sequence
  Description of Artificial Sequence: Synthetic oligonucleotide
ugcuguccccugggccucu

SEQ ID NO: 11589 - RNA, 19 nt, Artificial Sequence
  Description of Artificial Sequence: Synthetic oligonucleotide
uggcuguccccugggccuc

SEQ ID NO: 11590 - RNA, 19 nt, Artificial Sequence
  Description of Artificial Sequence: Synthetic oligonucleotide
uuggcuguccccugggccu

SEQ ID NO: 11591 - RNA, 19 nt, Artificial Sequence
  Description of Artificial Sequence: Synthetic oligonucleotide
ucuggcuguccccugggcc

SEQ ID NO: 11592 - RNA, 19 nt, Artificial Sequence
  Description of Artificial Sequence: Synthetic oligonucleotide
uccuggcuguccccugggc

SEQ ID NO: 11593 - RNA, 19 nt, Artificial Sequence
  Description of Artificial Sequence: Synthetic oligonucleotide
ucccuggcuguccccuggg

SEQ ID NO: 11594 - RNA, 19 nt, Artificial Sequence
  Description of Artificial Sequence: Synthetic oligonucleotide
uucccuggcuguccccugg

SEQ ID NO: 11595 - RNA, 19 nt, Artificial Sequence
  Description of Artificial Sequence: Synthetic oligonucleotide
ugucccuggcuguccccug

SEQ ID NO: 11596 - RNA, 19 nt, Artificial Sequence
  Description of Artificial Sequence: Synthetic oligonucleotide
uugucccuggcuguccccu

SEQ ID NO: 11597 - RNA, 19 nt, Artificial Sequence
  Description of Artificial Sequence: Synthetic oligonucleotide
ucugucccuggcugucccc

SEQ ID NO: 11598 - RNA, 19 nt, Artificial Sequence
  Description of Artificial Sequence: Synthetic oligonucleotide
uccugucccuggcuguccc

SEQ ID NO: 11599 - RNA, 19 nt, Artificial Sequence
  Description of Artificial Sequence: Synthetic oligonucleotide
ugccugucccuggcugucc

SEQ ID NO: 11600 - RNA, 19 nt, Artificial Sequence
  Description of Artificial Sequence: Synthetic oligonucleotide
uugccugucccuggcuguc

SEQ ID NO: 11601 - RNA, 19 nt, Artificial Sequence
  Description of Artificial Sequence: Synthetic oligonucleotide
ucugccugucccuggcugu

SEQ ID NO: 11602 - RNA, 19 nt, Artificial Sequence
  Description of Artificial Sequence: Synthetic oligonucleotide
uucugccugucccuggcug

SEQ ID NO: 11603 - RNA, 19 nt, Artificial Sequence
  Description of Artificial Sequence: Synthetic oligonucleotide
ugucugccugucccuggcu

SEQ ID NO: 11604 - RNA, 19 nt, Artificial Sequence
  Description of Artificial Sequence: Synthetic oligonucleotide
uugucugccugucccuggc

SEQ ID NO: 11605 - RNA, 19 nt, Artificial Sequence
  Description of Artificial Sequence: Synthetic oligonucleotide
uaugucugccugucccugg

SEQ ID NO: 11606 - RNA, 19 nt, Artificial Sequence
  Description of Artificial Sequence: Synthetic oligonucleotide
ucaugucugccugucccug

SEQ ID NO: 11607 - RNA, 19 nt, Artificial Sequence
  Description of Artificial Sequence: Synthetic oligonucleotide
ugcaugucugccugucccu

SEQ ID NO: 11608 - RNA, 19 nt, Artificial Sequence
  Description of Artificial Sequence: Synthetic oligonucleotide
uugcaugucugccuguccc

SEQ ID NO: 11609 - RNA, 19 nt, Artificial Sequence
  Description of Artificial Sequence: Synthetic oligonucleotide
ucugcaugucugccugucc

SEQ ID NO: 11610 - RNA, 19 nt, Artificial Sequence
  Description of Artificial Sequence: Synthetic oligonucleotide
ugcugcaugucugccuguc

SEQ ID NO: 11611 - RNA, 19 nt, Artificial Sequence
  Description of Artificial Sequence: Synthetic oligonucleotide
uggcugcaugucugccugu

SEQ ID NO: 11612 - RNA, 19 nt, Artificial Sequence
  Description of Artificial Sequence: Synthetic oligonucleotide
uuggcugcaugucugccug

SEQ ID NO: 11613 - RNA, 19 nt, Artificial Sequence
  Description of Artificial Sequence: Synthetic oligonucleotide
ucuggcugcaugucugccu

SEQ ID NO: 11614 - RNA, 19 nt, Artificial Sequence
  Description of Artificial Sequence: Synthetic oligonucleotide
uccuggcugcaugucugcc

SEQ ID NO: 11615 - RNA, 19 nt, Artificial Sequence
  Description of Artificial Sequence: Synthetic oligonucleotide
ucccuggcugcaugucugc

SEQ ID NO: 11616 - RNA, 19 nt, Artificial Sequence
  Description of Artificial Sequence: Synthetic oligonucleotide
ugcccuggcugcaugucug

SEQ ID NO: 11617 - RNA, 19 nt, Artificial Sequence
  Description of Artificial Sequence: Synthetic oligonucleotide
uagcccuggcugcaugucu

SEQ ID NO: 11618 - RNA, 19 nt, Artificial Sequence
  Description of Artificial Sequence: Synthetic oligonucleotide
ugagcccuggcugcauguc

SEQ ID NO: 11619 - RNA, 19 nt, Artificial Sequence
  Description of Artificial Sequence: Synthetic oligonucleotide
uggagcccuggcugcaugu

SEQ ID NO: 11620 - RNA, 19 nt, Artificial Sequence
  Description of Artificial Sequence: Synthetic oligonucleotide
uuggagcccuggcugcaug

SEQ ID NO: 11621 - RNA, 19 nt, Artificial Sequence
  Description of Artificial Sequence: Synthetic oligonucleotide
ucuggagcccuggcugcau

SEQ ID NO: 11622 - RNA, 19 nt, Artificial Sequence
  Description of Artificial Sequence: Synthetic oligonucleotide
uccuggagcccuggcugca

SEQ ID NO: 11623 - RNA, 19 nt, Artificial Sequence
  Description of Artificial Sequence: Synthetic oligonucleotide
ucccuggagcccuggcugc

SEQ ID NO: 11624 - RNA, 19 nt, Artificial Sequence
  Description of Artificial Sequence: Synthetic oligonucleotide
ugcccuggagcccuggcug

SEQ ID NO: 11625 - RNA, 19 nt, Artificial Sequence
  Description of Artificial Sequence: Synthetic oligonucleotide
uggcccuggagcccuggcu

SEQ ID NO: 11626 - RNA, 19 nt, Artificial Sequence
  Description of Artificial Sequence: Synthetic oligonucleotide
uaggcccuggagcccuggc

SEQ ID NO: 11627 - RNA, 19 nt, Artificial Sequence
  Description of Artificial Sequence: Synthetic oligonucleotide
ucaggcccuggagcccugg

SEQ ID NO: 11628 - RNA, 19 nt, Artificial Sequence
  Description of Artificial Sequence: Synthetic oligonucleotide
uccaggcccuggagcccug

SEQ ID NO: 11629 - RNA, 19 nt, Artificial Sequence
  Description of Artificial Sequence: Synthetic oligonucleotide
uuccaggcccuggagcccu

SEQ ID NO: 11630 - RNA, 19 nt, Artificial Sequence
  Description of Artificial Sequence: Synthetic oligonucleotide
uguccaggcccuggagccc

SEQ ID NO: 11631 - RNA, 19 nt, Artificial Sequence
  Description of Artificial Sequence: Synthetic oligonucleotide
uuguccaggcccuggagcc

SEQ ID NO: 11632 - RNA, 19 nt, Artificial Sequence
  Description of Artificial Sequence: Synthetic oligonucleotide
ucuguccaggcccuggagc

SEQ ID NO: 11633 - RNA, 19 nt, Artificial Sequence
  Description of Artificial Sequence: Synthetic oligonucleotide
uccuguccaggcccuggag

SEQ ID NO: 11634 - RNA, 19 nt, Artificial Sequence
  Description of Artificial Sequence: Synthetic oligonucleotide
ucccuguccaggcccugga

SEQ ID NO: 11635 - RNA, 19 nt, Artificial Sequence
  Description of Artificial Sequence: Synthetic oligonucleotide
uccccuguccaggcccugg

SEQ ID NO: 11636 - RNA, 19 nt, Artificial Sequence
  Description of Artificial Sequence: Synthetic oligonucleotide
ugccccuguccaggcccug

SEQ ID NO: 11637 - RNA, 19 nt, Artificial Sequence
  Description of Artificial Sequence: Synthetic oligonucleotide
uagccccuguccaggcccu

SEQ ID NO: 11638 - RNA, 19 nt, Artificial Sequence
  Description of Artificial Sequence: Synthetic oligonucleotide
ucagccccuguccaggccc

SEQ ID NO: 11639 - RNA, 19 nt, Artificial Sequence
  Description of Artificial Sequence: Synthetic oligonucleotide
ugcagccccuguccaggcc

SEQ ID NO: 11640 - RNA, 19 nt, Artificial Sequence
  Description of Artificial Sequence: Synthetic oligonucleotide
uggcagccccuguccaggc

SEQ ID NO: 11641 - RNA, 19 nt, Artificial Sequence
  Description of Artificial Sequence: Synthetic oligonucleotide
uuggcagccccuguccagg

SEQ ID NO: 11642 - RNA, 19 nt, Artificial Sequence
  Description of Artificial Sequence: Synthetic oligonucleotide
ucuggcagccccuguccag

SEQ ID NO: 11643 - RNA, 19 nt, Artificial Sequence
  Description of Artificial Sequence: Synthetic oligonucleotide
uccuggcagccccugucca

SEQ ID NO: 11644 - RNA, 19 nt, Artificial Sequence
  Description of Artificial Sequence: Synthetic oligonucleotide
ugccuggcagccccugucc

SEQ ID NO: 11645 - RNA, 19 nt, Artificial Sequence
  Description of Artificial Sequence: Synthetic oligonucleotide
uggccuggcagccccuguc

SEQ ID NO: 11646 - RNA, 19 nt, Artificial Sequence
  Description of Artificial Sequence: Synthetic oligonucleotide
ugggccuggcagccccugu

SEQ ID NO: 11647 - RNA, 19 nt, Artificial Sequence
  Description of Artificial Sequence: Synthetic oligonucleotide
uagggccuggcagccccug

SEQ ID NO: 11648 - RNA, 19 nt, Artificial Sequence
  Description of Artificial Sequence: Synthetic oligonucleotide
ucagggccuggcagccccu

SEQ ID NO: 11649 - RNA, 19 nt, Artificial Sequence
  Description of Artificial Sequence: Synthetic oligonucleotide
uacagggccuggcagcccc

SEQ ID NO: 11650 - RNA, 19 nt, Artificial Sequence
  Description of Artificial Sequence: Synthetic oligonucleotide
ucacagggccuggcagccc

SEQ ID NO: 11651 - RNA, 19 nt, Artificial Sequence
  Description of Artificial Sequence: Synthetic oligonucleotide
uucacagggccuggcagcc

SEQ ID NO: 11652 - RNA, 19 nt, Artificial Sequence
  Description of Artificial Sequence: Synthetic oligonucleotide
ugucacagggccuggcagc

SEQ ID NO: 11653 - RNA, 19 nt, Artificial Sequence
  Description of Artificial Sequence: Synthetic oligonucleotide
uugucacagggccuggcag

SEQ ID NO: 11654 - RNA, 19 nt, Artificial Sequence
  Description of Artificial Sequence: Synthetic oligonucleotide
ucugucacagggccuggca

SEQ ID NO: 11655 - RNA, 19 nt, Artificial Sequence
  Description of Artificial Sequence: Synthetic oligonucleotide
uccugucacagggccuggc

SEQ ID NO: 11656 - RNA, 19 nt, Artificial Sequence
  Description of Artificial Sequence: Synthetic oligonucleotide
uuccugucacagggccugg

SEQ ID NO: 11657 - RNA, 19 nt, Artificial Sequence
  Description of Artificial Sequence: Synthetic oligonucleotide
ucuccugucacagggccug

SEQ ID NO: 11658 - RNA, 19 nt, Artificial Sequence
  Description of Artificial Sequence: Synthetic oligonucleotide
uccuccugucacagggccu

SEQ ID NO: 11659 - RNA, 19 nt, Artificial Sequence
  Description of Artificial Sequence: Synthetic oligonucleotide
uuccuccugucacagggcc

SEQ ID NO: 11660 - RNA, 19 nt, Artificial Sequence
  Description of Artificial Sequence: Synthetic oligonucleotide
uguccuccugucacagggc

SEQ ID NO: 11661 - RNA, 19 nt, Artificial Sequence
  Description of Artificial Sequence: Synthetic oligonucleotide
ugguccuccugucacaggg

SEQ ID NO: 11662 - RNA, 19 nt, Artificial Sequence
  Description of Artificial Sequence: Synthetic oligonucleotide
uggguccuccugucacagg

SEQ ID NO: 11663 - RNA, 19 nt, Artificial Sequence
  Description of Artificial Sequence: Synthetic oligonucleotide
ugggguccuccugucacag

SEQ ID NO: 11664 - RNA, 19 nt, Artificial Sequence
  Description of Artificial Sequence: Synthetic oligonucleotide
ucgggguccuccugucaca

SEQ ID NO: 11665 - RNA, 19 nt, Artificial Sequence
  Description of Artificial Sequence: Synthetic oligonucleotide
uucgggguccuccugucac

SEQ ID NO: 11666 - RNA, 19 nt, Artificial Sequence
  Description of Artificial Sequence: Synthetic oligonucleotide
ucucgggguccuccuguca

SEQ ID NO: 11667 - RNA, 19 nt, Artificial Sequence
  Description of Artificial Sequence: Synthetic oligonucleotide
ugcucgggguccuccuguc

SEQ ID NO: 11668 - RNA, 19 nt, Artificial Sequence
  Description of Artificial Sequence: Synthetic oligonucleotide
uggcucgggguccuccugu

SEQ ID NO: 11669 - RNA, 19 nt, Artificial Sequence
  Description of Artificial Sequence: Synthetic oligonucleotide
ugggcucgggguccuccug

SEQ ID NO: 11670 - RNA, 19 nt, Artificial Sequence
  Description of Artificial Sequence: Synthetic oligonucleotide
uggggcucgggguccuccu

SEQ ID NO: 11671 - RNA, 19 nt, Artificial Sequence
  Description of Artificial Sequence: Synthetic oligonucleotide
ugggggcucgggguccucc

SEQ ID NO: 11672 - RNA, 19 nt, Artificial Sequence
  Description of Artificial Sequence: Synthetic oligonucleotide
ucgggggcucgggguccuc

SEQ ID NO: 11673 - RNA, 19 nt, Artificial Sequence
  Description of Artificial Sequence: Synthetic oligonucleotide
uccgggggcucgggguccu

SEQ ID NO: 11674 - RNA, 19 nt, Artificial Sequence
  Description of Artificial Sequence: Synthetic oligonucleotide
ugccgggggcucggggucc

SEQ ID NO: 11675 - RNA, 19 nt, Artificial Sequence
  Description of Artificial Sequence: Synthetic oligonucleotide
uggccgggggcucgggguc

SEQ ID NO: 11676 - RNA, 19 nt, Artificial Sequence
  Description of Artificial Sequence: Synthetic oligonucleotide
ugggccgggggcucggggu

SEQ ID NO: 11677 - RNA, 19 nt, Artificial Sequence
  Description of Artificial Sequence: Synthetic oligonucleotide
ucgggccgggggcucgggg

SEQ ID NO: 11678 - RNA, 19 nt, Artificial Sequence
  Description of Artificial Sequence: Synthetic oligonucleotide
uccgggccgggggcucggg

SEQ ID NO: 11679 - RNA, 19 nt, Artificial Sequence
  Description of Artificial Sequence: Synthetic oligonucleotide
ucccgggccgggggcucgg

SEQ ID NO: 11680 - RNA, 19 nt, Artificial Sequence
  Description of Artificial Sequence: Synthetic oligonucleotide
uccccgggccgggggcucg

SEQ ID NO: 11681 - RNA, 19 nt, Artificial Sequence
  Description of Artificial Sequence: Synthetic oligonucleotide
uuccccgggccgggggcuc

SEQ ID NO: 11682 - RNA, 19 nt, Artificial Sequence
  Description of Artificial Sequence: Synthetic oligonucleotide
ucuccccgggccgggggcu

SEQ ID NO: 11683 - RNA, 19 nt, Artificial Sequence
  Description of Artificial Sequence: Synthetic oligonucleotide
uccuccccgggccgggggc

SEQ ID NO: 11684 - RNA, 19 nt, Artificial Sequence
  Description of Artificial Sequence: Synthetic oligonucleotide
ucccuccccgggccggggg

SEQ ID NO: 11685 - RNA, 19 nt, Artificial Sequence
  Description of Artificial Sequence: Synthetic oligonucleotide
uccccuccccgggccgggg

SEQ ID NO: 11686 - RNA, 19 nt, Artificial Sequence
  Description of Artificial Sequence: Synthetic oligonucleotide
ugccccuccccgggccggg

SEQ ID NO: 11687 - RNA, 19 nt, Artificial Sequence
  Description of Artificial Sequence: Synthetic oligonucleotide
uggccccuccccgggccgg

SEQ ID NO: 11688 - RNA, 19 nt, Artificial Sequence
  Description of Artificial Sequence: Synthetic oligonucleotide
uuggccccuccccgggccg

SEQ ID NO: 11689 - RNA, 19 nt, Artificial Sequence
  Description of Artificial Sequence: Synthetic oligonucleotide
uauggccccuccccgggcc

SEQ ID NO: 11690 - RNA, 19 nt, Artificial Sequence
  Description of Artificial Sequence: Synthetic oligonucleotide
ucauggccccuccccgggc

SEQ ID NO: 11691 - RNA, 19 nt, Artificial Sequence
  Description of Artificial Sequence: Synthetic oligonucleotide
uccauggccccuccccggg

SEQ ID NO: 11692 - RNA, 19 nt, Artificial Sequence
  Description of Artificial Sequence: Synthetic oligonucleotide
uaccauggccccuccccgg

SEQ ID NO: 11693 - RNA, 19 nt, Artificial Sequence
  Description of Artificial Sequence: Synthetic oligonucleotide
ucaccauggccccuccccg

SEQ ID NO: 11694 - RNA, 19 nt, Artificial Sequence
  Description of Artificial Sequence: Synthetic oligonucleotide
ugcaccauggccccucccc

SEQ ID NO: 11695 - RNA, 19 nt, Artificial Sequence
  Description of Artificial Sequence: Synthetic oligonucleotide
uagcaccauggccccuccc

SEQ ID NO: 11696 - RNA, 19 nt, Artificial Sequence
  Description of Artificial Sequence: Synthetic oligonucleotide
ucagcaccauggccccucc

SEQ ID NO: 11697 - RNA, 19 nt, Artificial Sequence
  Description of Artificial Sequence: Synthetic oligonucleotide
ugcagcaccauggccccuc

SEQ ID NO: 11698 - RNA, 19 nt, Artificial Sequence
  Description of Artificial Sequence: Synthetic oligonucleotide
uggcagcaccauggccccu

SEQ ID NO: 11699 - RNA, 19 nt, Artificial Sequence
  Description of Artificial Sequence: Synthetic oligonucleotide
uaggcagcaccauggcccc

SEQ ID NO: 11700 - RNA, 19 nt, Artificial Sequence
  Description of Artificial Sequence: Synthetic oligonucleotide
ucaggcagcaccauggccc

SEQ ID NO: 11701 - RNA, 19 nt, Artificial Sequence
  Description of Artificial Sequence: Synthetic oligonucleotide
uacaggcagcaccauggcc

SEQ ID NO: 11702 - RNA, 19 nt, Artificial Sequence
  Description of Artificial Sequence: Synthetic oligonucleotide
ugacaggcagcaccauggc

SEQ ID NO: 11703 - RNA, 19 nt, Artificial Sequence
  Description of Artificial Sequence: Synthetic oligonucleotide
uggacaggcagcaccaugg

SEQ ID NO: 11704 - RNA, 19 nt, Artificial Sequence
  Description of Artificial Sequence: Synthetic oligonucleotide
uuggacaggcagcaccaug

SEQ ID NO: 11705 - RNA, 19 nt, Artificial Sequence
  Description of Artificial Sequence: Synthetic oligonucleotide
uuuggacaggcagcaccau

SEQ ID NO: 11706 - RNA, 19 nt, Artificial Sequence
  Description of Artificial Sequence: Synthetic oligonucleotide
uguuggacaggcagcacca

SEQ ID NO: 11707 - RNA, 19 nt, Artificial Sequence
  Description of Artificial Sequence: Synthetic oligonucleotide
uuguuggacaggcagcacc

SEQ ID NO: 11708 - RNA, 19 nt, Artificial Sequence
  Description of Artificial Sequence: Synthetic oligonucleotide
uauguuggacaggcagcac

SEQ ID NO: 11709 - RNA, 19 nt, Artificial Sequence
  Description of Artificial Sequence: Synthetic oligonucleotide
ucauguuggacaggcagca

SEQ ID NO: 11710 - RNA, 19 nt, Artificial Sequence
  Description of Artificial Sequence: Synthetic oligonucleotide
uacauguuggacaggcagc

SEQ ID NO: 11711 - RNA, 19 nt, Artificial Sequence
  Description of Artificial Sequence: Synthetic oligonucleotide
ugacauguuggacaggcag

SEQ ID NO: 11712 - RNA, 19 nt, Artificial Sequence
  Description of Artificial Sequence: Synthetic oligonucleotide
uugacauguuggacaggca

SEQ ID NO: 11713 - RNA, 19 nt, Artificial Sequence
  Description of Artificial Sequence: Synthetic oligonucleotide
ucugacauguuggacaggc

SEQ ID NO: 11714 - RNA, 19 nt, Artificial Sequence
  Description of Artificial Sequence: Synthetic oligonucleotide
ugcugacauguuggacagg

SEQ ID NO: 11715 - RNA, 19 nt, Artificial Sequence
  Description of Artificial Sequence: Synthetic oligonucleotide
uggcugacauguuggacag

SEQ ID NO: 11716 - RNA, 19 nt, Artificial Sequence
  Description of Artificial Sequence: Synthetic oligonucleotide
ucggcugacauguuggaca

SEQ ID NO: 11717 - RNA, 19 nt, Artificial Sequence
  Description of Artificial Sequence: Synthetic oligonucleotide
uucggcugacauguuggac

SEQ ID NO: 11718 - RNA, 19 nt, Artificial Sequence
  Description of Artificial Sequence: Synthetic oligonucleotide
ucucggcugacauguugga

SEQ ID NO: 11719 - RNA, 19 nt, Artificial Sequence
  Description of Artificial Sequence: Synthetic oligonucleotide
uccucggcugacauguugg

SEQ ID NO: 11720 - RNA, 19 nt, Artificial Sequence
  Description of Artificial Sequence: Synthetic oligonucleotide
uaccucggcugacauguug

SEQ ID NO: 11721 - RNA, 19 nt, Artificial Sequence
  Description of Artificial Sequence: Synthetic oligonucleotide
ucaccucggcugacauguu

SEQ ID NO: 11722 - RNA, 19 nt, Artificial Sequence
  Description of Artificial Sequence: Synthetic oligonucleotide
ugcaccucggcugacaugu

SEQ ID NO: 11723 - RNA, 19 nt, Artificial Sequence
  Description of Artificial Sequence: Synthetic oligonucleotide
ucgcaccucggcugacaug

SEQ ID NO: 11724 - RNA, 19 nt, Artificial Sequence
  Description of Artificial Sequence: Synthetic oligonucleotide
uccgcaccucggcugacau

SEQ ID NO: 11725 - RNA, 19 nt, Artificial Sequence
  Description of Artificial Sequence: Synthetic oligonucleotide
ugccgcaccucggcugaca

SEQ ID NO: 11726 - RNA, 19 nt, Artificial Sequence
  Description of Artificial Sequence: Synthetic oligonucleotide
uagccgcaccucggcugac

SEQ ID NO: 11727 - RNA, 19 nt, Artificial Sequence
  Description of Artificial Sequence: Synthetic oligonucleotide
ucagccgcaccucggcuga

SEQ ID NO: 11728 - RNA, 19 nt, Artificial Sequence
  Description of Artificial Sequence: Synthetic oligonucleotide
uucagccgcaccucggcug

SEQ ID NO: 11729 - RNA, 19 nt, Artificial Sequence
  Description of Artificial Sequence: Synthetic oligonucleotide
ucucagccgcaccucggcu

SEQ ID NO: 11730 - RNA, 19 nt, Artificial Sequence
  Description of Artificial Sequence: Synthetic oligonucleotide
uccucagccgcaccucggc

SEQ ID NO: 11731 - RNA, 19 nt, Artificial Sequence
  Description of Artificial Sequence: Synthetic oligonucleotide
ugccucagccgcaccucgg

SEQ ID NO: 11732 - RNA, 19 nt, Artificial Sequence
  Description of Artificial Sequence: Synthetic oligonucleotide
ucgccucagccgcaccucg

SEQ ID NO: 11733 - RNA, 19 nt, Artificial Sequence
  Description of Artificial Sequence: Synthetic oligonucleotide
uccgccucagccgcaccuc

SEQ ID NO: 11734 - RNA, 19 nt, Artificial Sequence
  Description of Artificial Sequence: Synthetic oligonucleotide
ugccgccucagccgcaccu

SEQ ID NO: 11735 - RNA, 19 nt, Artificial Sequence
  Description of Artificial Sequence: Synthetic oligonucleotide
uagccgccucagccgcacc

SEQ ID NO: 11736 - RNA, 19 nt, Artificial Sequence
  Description of Artificial Sequence: Synthetic oligonucleotide
ugagccgccucagccgcac

SEQ ID NO: 11737 - RNA, 19 nt, Artificial Sequence
  Description of Artificial Sequence: Synthetic oligonucleotide
uggagccgccucagccgca

SEQ ID NO: 11738 - RNA, 19 nt, Artificial Sequence
  Description of Artificial Sequence: Synthetic oligonucleotide
uuggagccgccucagccgc

SEQ ID NO: 11739 - RNA, 19 nt, Artificial Sequence
  Description of Artificial Sequence: Synthetic oligonucleotide
ucuggagccgccucagccg

SEQ ID NO: 11740 - RNA, 19 nt, Artificial Sequence
  Description of Artificial Sequence: Synthetic oligonucleotide
ugcuggagccgccucagcc

SEQ ID NO: 11741 - RNA, 19 nt, Artificial Sequence
  Description of Artificial Sequence: Synthetic oligonucleotide
uugcuggagccgccucagc

SEQ ID NO: 11742 - RNA, 19 nt, Artificial Sequence
  Description of Artificial Sequence: Synthetic oligonucleotide
ucugcuggagccgccucag

SEQ ID NO: 11743 - RNA, 19 nt, Artificial Sequence
  Description of Artificial Sequence: Synthetic oligonucleotide
ugcugcuggagccgccuca

SEQ ID NO: 11744 - RNA, 19 nt, Artificial Sequence
  Description of Artificial Sequence: Synthetic oligonucleotide
uagcugcuggagccgccuc

SEQ ID NO: 11745 - RNA, 19 nt, Artificial Sequence
  Description of Artificial Sequence: Synthetic oligonucleotide
ucagcugcuggagccgccu

SEQ ID NO: 11746 - RNA, 19 nt, Artificial Sequence
  Description of Artificial Sequence: Synthetic oligonucleotide
uccagcugcuggagccgcc

SEQ ID NO: 11747 - RNA, 19 nt, Artificial Sequence
  Description of Artificial Sequence: Synthetic oligonucleotide
uaccagcugcuggagccgc

SEQ ID NO: 11748 - RNA, 19 nt, Artificial Sequence
  Description of Artificial Sequence: Synthetic oligonucleotide
ucaccagcugcuggagccg

SEQ ID NO: 11749 - RNA, 19 nt, Artificial Sequence
  Description of Artificial Sequence: Synthetic oligonucleotide
uacaccagcugcuggagcc

SEQ ID NO: 11750 - RNA, 19 nt, Artificial Sequence
  Description of Artificial Sequence: Synthetic oligonucleotide
uaacaccagcugcuggagc

SEQ ID NO: 11751 - RNA, 19 nt, Artificial Sequence
  Description of Artificial Sequence: Synthetic oligonucleotide
ucaacaccagcugcuggag

SEQ ID NO: 11752 - RNA, 19 nt, Artificial Sequence
  Description of Artificial Sequence: Synthetic oligonucleotide
uccaacaccagcugcugga

SEQ ID NO: 11753 - RNA, 19 nt, Artificial Sequence
  Description of Artificial Sequence: Synthetic oligonucleotide
uuccaacaccagcugcugg

SEQ ID NO: 11754 - RNA, 19 nt, Artificial Sequence
  Description of Artificial Sequence: Synthetic oligonucleotide
uguccaacaccagcugcug

SEQ ID NO: 11755 - RNA, 19 nt, Artificial Sequence
  Description of Artificial Sequence: Synthetic oligonucleotide
ugguccaacaccagcugcu

SEQ ID NO: 11756 - RNA, 19 nt, Artificial Sequence
  Description of Artificial Sequence: Synthetic oligonucleotide
uggguccaacaccagcugc

SEQ ID NO: 11757 - RNA, 19 nt, Artificial Sequence
  Description of Artificial Sequence: Synthetic oligonucleotide
ucggguccaacaccagcug

SEQ ID NO: 11758 - RNA, 19 nt, Artificial Sequence
  Description of Artificial Sequence: Synthetic oligonucleotide
uccggguccaacaccagcu

SEQ ID NO: 11759 - RNA, 19 nt, Artificial Sequence
  Description of Artificial Sequence: Synthetic oligonucleotide
ucccggguccaacaccagc

SEQ ID NO: 11760 - RNA, 19 nt, Artificial Sequence
  Description of Artificial Sequence: Synthetic oligonucleotide
ugcccggguccaacaccag

SEQ ID NO: 11761 - RNA, 19 nt, Artificial Sequence
  Description of Artificial Sequence: Synthetic oligonucleotide
uagcccggguccaacacca

SEQ ID NO: 11762 - RNA, 19 nt, Artificial Sequence
  Description of Artificial Sequence: Synthetic oligonucleotide
uaagcccggguccaacacc

SEQ ID NO: 11763 - RNA, 19 nt, Artificial Sequence
  Description of Artificial Sequence: Synthetic oligonucleotide
ugaagcccggguccaacac

SEQ ID NO: 11764 - RNA, 19 nt, Artificial Sequence
  Description of Artificial Sequence: Synthetic oligonucleotide
uggaagcccggguccaaca

SEQ ID NO: 11765 - RNA, 19 nt, Artificial Sequence
  Description of Artificial Sequence: Synthetic oligonucleotide
uaggaagcccggguccaac

SEQ ID NO: 11766 - RNA, 19 nt, Artificial Sequence
  Description of Artificial Sequence: Synthetic oligonucleotide
ucaggaagcccggguccaa

SEQ ID NO: 11767 - RNA, 19 nt, Artificial Sequence
  Description of Artificial Sequence: Synthetic oligonucleotide
uccaggaagcccgggucca

SEQ ID NO: 11768 - RNA, 19 nt, Artificial Sequence
  Description of Artificial Sequence: Synthetic oligonucleotide
ucccaggaagcccgggucc

SEQ ID NO: 11769 - RNA, 19 nt, Artificial Sequence
  Description of Artificial Sequence: Synthetic oligonucleotide
uccccaggaagcccggguc

SEQ ID NO: 11770 - RNA, 19 nt, Artificial Sequence
  Description of Artificial Sequence: Synthetic oligonucleotide
ugccccaggaagcccgggu

SEQ ID NO: 11771 - RNA, 19 nt, Artificial Sequence
  Description of Artificial Sequence: Synthetic oligonucleotide
uagccccaggaagcccggg

SEQ ID NO: 11772 - RNA, 19 nt, Artificial Sequence
  Description of Artificial Sequence: Synthetic oligonucleotide
ucagccccaggaagcccgg

SEQ ID NO: 11773 - RNA, 19 nt, Artificial Sequence
  Description of Artificial Sequence: Synthetic oligonucleotide
uccagccccaggaagcccg

SEQ ID NO: 11774 - RNA, 19 nt, Artificial Sequence
  Description of Artificial Sequence: Synthetic oligonucleotide
uuccagccccaggaagccc

SEQ ID NO: 11775 - RNA, 19 nt, Artificial Sequence
  Description of Artificial Sequence: Synthetic oligonucleotide
ucuccagccccaggaagcc

SEQ ID NO: 11776 - RNA, 19 nt, Artificial Sequence
  Description of Artificial Sequence: Synthetic oligonucleotide
ugcuccagccccaggaagc

SEQ ID NO: 11777 - RNA, 19 nt, Artificial Sequence
  Description of Artificial Sequence: Synthetic oligonucleotide
uggcuccagccccaggaag

SEQ ID NO: 11778 - RNA, 19 nt, Artificial Sequence
  Description of Artificial Sequence: Synthetic oligonucleotide
ugggcuccagccccaggaa

SEQ ID NO: 11779 - RNA, 19 nt, Artificial Sequence
  Description of Artificial Sequence: Synthetic oligonucleotide
uggggcuccagccccagga

SEQ ID NO: 11780 - RNA, 19 nt, Artificial Sequence
  Description of Artificial Sequence: Synthetic oligonucleotide
uaggggcuccagccccagg

SEQ ID NO: 11781 - RNA, 19 nt, Artificial Sequence
  Description of Artificial Sequence: Synthetic oligonucleotide
ucaggggcuccagccccag

SEQ ID NO: 11782 - RNA, 19 nt, Artificial Sequence
  Description of Artificial Sequence: Synthetic oligonucleotide
ugcaggggcuccagcccca

SEQ ID NO: 11783 - RNA, 19 nt, Artificial Sequence
  Description of Artificial Sequence: Synthetic oligonucleotide
uagcaggggcuccagcccc

SEQ ID NO: 11784 - RNA, 19 nt, Artificial Sequence
  Description of Artificial Sequence: Synthetic oligonucleotide
ugagcaggggcuccagccc

SEQ ID NO: 11785 - RNA, 19 nt, Artificial Sequence
  Description of Artificial Sequence: Synthetic oligonucleotide
ucgagcaggggcuccagcc

SEQ ID NO: 11786 - RNA, 19 nt, Artificial Sequence
  Description of Artificial Sequence: Synthetic oligonucleotide
uucgagcaggggcuccagc

SEQ ID NO: 11787 - RNA, 19 nt, Artificial Sequence
  Description of Artificial Sequence: Synthetic oligonucleotide
ugucgagcaggggcuccag

SEQ ID NO: 11788 - RNA, 19 nt, Artificial Sequence
  Description of Artificial Sequence: Synthetic oligonucleotide
uggucgagcaggggcucca

SEQ ID NO: 11789 - RNA, 19 nt, Artificial Sequence
  Description of Artificial Sequence: Synthetic oligonucleotide
uaggucgagcaggggcucc

SEQ ID NO: 11790 - RNA, 19 nt, Artificial Sequence
  Description of Artificial Sequence: Synthetic oligonucleotide
uaaggucgagcaggggcuc

SEQ ID NO: 11791 - RNA, 19 nt, Artificial Sequence
  Description of Artificial Sequence: Synthetic oligonucleotide
ugaaggucgagcaggggcu

SEQ ID NO: 11792 - RNA, 19 nt, Artificial Sequence
  Description of Artificial Sequence: Synthetic oligonucleotide
uagaaggucgagcaggggc

SEQ ID NO: 11793 - RNA, 19 nt, Artificial Sequence
  Description of Artificial Sequence: Synthetic oligonucleotide
ugagaaggucgagcagggg

SEQ ID NO: 11794 - RNA, 19 nt, Artificial Sequence
  Description of Artificial Sequence: Synthetic oligonucleotide
uggagaaggucgagcaggg

SEQ ID NO: 11795 - RNA, 19 nt, Artificial Sequence
  Description of Artificial Sequence: Synthetic oligonucleotide
uaggagaaggucgagcagg

SEQ ID NO: 11796 - RNA, 19 nt, Artificial Sequence
  Description of Artificial Sequence: Synthetic oligonucleotide
ucaggagaaggucgagcag

SEQ ID NO: 11797 - RNA, 19 nt, Artificial Sequence
  Description of Artificial Sequence: Synthetic oligonucleotide
uccaggagaaggucgagca

SEQ ID NO: 11798 - RNA, 19 nt, Artificial Sequence
  Description of Artificial Sequence: Synthetic oligonucleotide
ucccaggagaaggucgagc

SEQ ID NO: 11799 - RNA, 19 nt, Artificial Sequence
  Description of Artificial Sequence: Synthetic oligonucleotide
ugcccaggagaaggucgag

SEQ ID NO: 11800 - RNA, 19 nt, Artificial Sequence
  Description of Artificial Sequence: Synthetic oligonucleotide
ucgcccaggagaaggucga

SEQ ID NO: 11801 - RNA, 19 nt, Artificial Sequence
  Description of Artificial Sequence: Synthetic oligonucleotide
uacgcccaggagaaggucg

SEQ ID NO: 11802 - RNA, 19 nt, Artificial Sequence
  Description of Artificial Sequence: Synthetic oligonucleotide
ugacgcccaggagaagguc

SEQ ID NO: 11803 - RNA, 19 nt, Artificial Sequence
  Description of Artificial Sequence: Synthetic oligonucleotide
uggacgcccaggagaaggu

SEQ ID NO: 11804 - RNA, 19 nt, Artificial Sequence
  Description of Artificial Sequence: Synthetic oligonucleotide
uuggacgcccaggagaagg

SEQ ID NO: 11805 - RNA, 19 nt, Artificial Sequence
  Description of Artificial Sequence: Synthetic oligonucleotide
uguggacgcccaggagaag

SEQ ID NO: 11806 - RNA, 19 nt, Artificial Sequence
  Description of Artificial Sequence: Synthetic oligonucleotide
ugguggacgcccaggagaa

SEQ ID NO: 11807 - RNA, 19 nt, Artificial Sequence
  Description of Artificial Sequence: Synthetic oligonucleotide
uugguggacgcccaggaga

SEQ ID NO: 11808 - RNA, 19 nt, Artificial Sequence
  Description of Artificial Sequence: Synthetic oligonucleotide
ucugguggacgcccaggag

SEQ ID NO: 11809 - RNA, 19 nt, Artificial Sequence
  Description of Artificial Sequence: Synthetic oligonucleotide
uccugguggacgcccagga

SEQ ID NO: 11810 - RNA, 19 nt, Artificial Sequence
  Description of Artificial Sequence: Synthetic oligonucleotide
uuccugguggacgcccagg

SEQ ID NO: 11811 - RNA, 19 nt, Artificial Sequence
  Description of Artificial Sequence: Synthetic oligonucleotide
ucuccugguggacgcccag

SEQ ID NO: 11812 - RNA, 19 nt, Artificial Sequence
  Description of Artificial Sequence: Synthetic oligonucleotide
ugcuccugguggacgccca

SEQ ID NO: 11813 - RNA, 19 nt, Artificial Sequence
  Description of Artificial Sequence: Synthetic oligonucleotide
uagcuccugguggacgccc

SEQ ID NO: 11814 - RNA, 19 nt, Artificial Sequence
  Description of Artificial Sequence: Synthetic oligonucleotide
ucagcuccugguggacgcc

SEQ ID NO: 11815 - RNA, 19 nt, Artificial Sequence
  Description of Artificial Sequence: Synthetic oligonucleotide
uccagcuccugguggacgc

SEQ ID NO: 11816 - RNA, 19 nt, Artificial Sequence
  Description of Artificial Sequence: Synthetic oligonucleotide
ucccagcuccugguggacg

SEQ ID NO: 11817 - RNA, 19 nt, Artificial Sequence
  Description of Artificial Sequence: Synthetic oligonucleotide
ugcccagcuccugguggac

SEQ ID NO: 11818 - RNA, 19 nt, Artificial Sequence
  Description of Artificial Sequence: Synthetic oligonucleotide
ucgcccagcuccuggugga

SEQ ID NO: 11819 - RNA, 19 nt, Artificial Sequence
  Description of Artificial Sequence: Synthetic oligonucleotide
ugcgcccagcuccuggugg

SEQ ID NO: 11820 - RNA, 19 nt, Artificial Sequence
  Description of Artificial Sequence: Synthetic oligonucleotide
uggcgcccagcuccuggug

SEQ ID NO: 11821 - RNA, 19 nt, Artificial Sequence
  Description of Artificial Sequence: Synthetic oligonucleotide
uaggcgcccagcuccuggu

SEQ ID NO: 11822 - RNA, 19 nt, Artificial Sequence
  Description of Artificial Sequence: Synthetic oligonucleotide
ugaggcgcccagcuccugg

SEQ ID NO: 11823 - RNA, 19 nt, Artificial Sequence
  Description of Artificial Sequence: Synthetic oligonucleotide
uggaggcgcccagcuccug

SEQ ID NO: 11824 - RNA, 19 nt, Artificial Sequence
  Description of Artificial Sequence: Synthetic oligonucleotide
ucggaggcgcccagcuccu

SEQ ID NO: 11825 - RNA, 19 nt, Artificial Sequence
  Description of Artificial Sequence: Synthetic oligonucleotide
uucggaggcgcccagcucc

SEQ ID NO: 11826 - RNA, 19 nt, Artificial Sequence
  Description of Artificial Sequence: Synthetic oligonucleotide
uuucggaggcgcccagcuc

SEQ ID NO: 11827 - RNA, 19 nt, Artificial Sequence
  Description of Artificial Sequence: Synthetic oligonucleotide
uguucggaggcgcccagcu

SEQ ID NO: 11828 - RNA, 19 nt, Artificial Sequence
  Description of Artificial Sequence: Synthetic oligonucleotide
uaguucggaggcgcccagc

SEQ ID NO: 11829 - RNA, 19 nt, Artificial Sequence
  Description of Artificial Sequence: Synthetic oligonucleotide
ucaguucggaggcgcccag

SEQ ID NO: 11830 - RNA, 19 nt, Artificial Sequence
  Description of Artificial Sequence: Synthetic oligonucleotide
uccaguucggaggcgccca

SEQ ID NO: 11831 - RNA, 19 nt, Artificial Sequence
  Description of Artificial Sequence: Synthetic oligonucleotide
ugccaguucggaggcgccc

SEQ ID NO: 11832 - RNA, 19 nt, Artificial Sequence
  Description of Artificial Sequence: Synthetic oligonucleotide
uggccaguucggaggcgcc

SEQ ID NO: 11833 - RNA, 19 nt, Artificial Sequence
  Description of Artificial Sequence: Synthetic oligonucleotide
ugggccaguucggaggcgc

SEQ ID NO: 11834 - RNA, 19 nt, Artificial Sequence
  Description of Artificial Sequence: Synthetic oligonucleotide
uugggccaguucggaggcg

SEQ ID NO: 11835 - RNA, 19 nt, Artificial Sequence
  Description of Artificial Sequence: Synthetic oligonucleotide
ucugggccaguucggaggc

SEQ ID NO: 11836 - RNA, 19 nt, Artificial Sequence
  Description of Artificial Sequence: Synthetic oligonucleotide
uccugggccaguucggagg

SEQ ID NO: 11837 - RNA, 19 nt, Artificial Sequence
  Description of Artificial Sequence: Synthetic oligonucleotide
uuccugggccaguucggag

SEQ ID NO: 11838 - RNA, 19 nt, Artificial Sequence
  Description of Artificial Sequence: Synthetic oligonucleotide
uguccugggccaguucgga

SEQ ID NO: 11839 - RNA, 19 nt, Artificial Sequence
  Description of Artificial Sequence: Synthetic oligonucleotide
uuguccugggccaguucgg

SEQ ID NO: 11840 - RNA, 19 nt, Artificial Sequence
  Description of Artificial Sequence: Synthetic oligonucleotide
uuuguccugggccaguucg

SEQ ID NO: 11841 - RNA, 19 nt, Artificial Sequence
  Description of Artificial Sequence: Synthetic oligonucleotide
ucuuguccugggccaguuc

SEQ ID NO: 11842 - RNA, 19 nt, Artificial Sequence
  Description of Artificial Sequence: Synthetic oligonucleotide
uacuuguccugggccaguu

SEQ ID NO: 11843 - RNA, 19 nt, Artificial Sequence
  Description of Artificial Sequence: Synthetic oligonucleotide
uuacuuguccugggccagu

SEQ ID NO: 11844 - RNA, 19 nt, Artificial Sequence
  Description of Artificial Sequence: Synthetic oligonucleotide
uguacuuguccugggccag

SEQ ID NO: 11845 - RNA, 19 nt, Artificial Sequence
  Description of Artificial Sequence: Synthetic oligonucleotide
ucguacuuguccugggcca

SEQ ID NO: 11846 - RNA, 19 nt, Artificial Sequence
  Description of Artificial Sequence: Synthetic oligonucleotide
uacguacuuguccugggcc

SEQ ID NO: 11847 - RNA, 19 nt, Artificial Sequence
  Description of Artificial Sequence: Synthetic oligonucleotide
ucacguacuuguccugggc

SEQ ID NO: 11848 - RNA, 19 nt, Artificial Sequence
  Description of Artificial Sequence: Synthetic oligonucleotide
uccacguacuuguccuggg

SEQ ID NO: 11849 - RNA, 19 nt, Artificial Sequence
  Description of Artificial Sequence: Synthetic oligonucleotide
ugccacguacuuguccugg

SEQ ID NO: 11850 - RNA, 19 nt, Artificial Sequence
  Description of Artificial Sequence: Synthetic oligonucleotide
uggccacguacuuguccug

SEQ ID NO: 11851 - RNA, 19 nt, Artificial Sequence
  Description of Artificial Sequence: Synthetic oligonucleotide
ucggccacguacuuguccu

SEQ ID NO: 11852 - RNA, 19 nt, Artificial Sequence
  Description of Artificial Sequence: Synthetic oligonucleotide
uucggccacguacuugucc

SEQ ID NO: 11853 - RNA, 19 nt, Artificial Sequence
  Description of Artificial Sequence: Synthetic oligonucleotide
ugucggccacguacuuguc

SEQ ID NO: 11854 - RNA, 19 nt, Artificial Sequence
  Description of Artificial Sequence: Synthetic oligonucleotide
uagucggccacguacuugu

SEQ ID NO: 11855 - RNA, 19 nt, Artificial Sequence
  Description of Artificial Sequence: Synthetic oligonucleotide
uaagucggccacguacuug

SEQ ID NO: 11856 - RNA, 19 nt, Artificial Sequence
  Description of Artificial Sequence: Synthetic oligonucleotide
ugaagucggccacguacuu

SEQ ID NO: 11857 - RNA, 19 nt, Artificial Sequence
  Description of Artificial Sequence: Synthetic oligonucleotide
uagaagucggccacguacu

SEQ ID NO: 11858 - RNA, 19 nt, Artificial Sequence
  Description of Artificial Sequence: Synthetic oligonucleotide
uaagaagucggccacguac

SEQ ID NO: 11859 - RNA, 19 nt, Artificial Sequence
  Description of Artificial Sequence: Synthetic oligonucleotide
ucaagaagucggccacgua

SEQ ID NO: 11860 - RNA, 19 nt, Artificial Sequence
  Description of Artificial Sequence: Synthetic oligonucleotide
ugcaagaagucggccacgu

SEQ ID NO: 11861 - RNA, 19 nt, Artificial Sequence
  Description of Artificial Sequence: Synthetic oligonucleotide
uugcaagaagucggccacg

SEQ ID NO: 11862 - RNA, 19 nt, Artificial Sequence
  Description of Artificial Sequence: Synthetic oligonucleotide
ucugcaagaagucggccac

SEQ ID NO: 11863 - RNA, 19 nt, Artificial Sequence
  Description of Artificial Sequence: Synthetic oligonucleotide
uacugcaagaagucggcca

SEQ ID NO: 11864 - RNA, 19 nt, Artificial Sequence
  Description of Artificial Sequence: Synthetic oligonucleotide
ucacugcaagaagucggcc

SEQ ID NO: 11865 - RNA, 19 nt, Artificial Sequence
  Description of Artificial Sequence: Synthetic oligonucleotide
uccacugcaagaagucggc

SEQ ID NO: 11866 - RNA, 19 nt, Artificial Sequence
  Description of Artificial Sequence: Synthetic oligonucleotide
ucccacugcaagaagucgg

SEQ ID NO: 11867 - RNA, 19 nt, Artificial Sequence
  Description of Artificial Sequence: Synthetic oligonucleotide
ugcccacugcaagaagucg

SEQ ID NO: 11868 - RNA, 19 nt, Artificial Sequence
  Description of Artificial Sequence: Synthetic oligonucleotide
ucgcccacugcaagaaguc

SEQ ID NO: 11869 - RNA, 19 nt, Artificial Sequence
  Description of Artificial Sequence: Synthetic oligonucleotide
uccgcccacugcaagaagu

SEQ ID NO: 11870 - RNA, 19 nt, Artificial Sequence
  Description of Artificial Sequence: Synthetic oligonucleotide
uuccgcccacugcaagaag

SEQ ID NO: 11871 - RNA, 19 nt, Artificial Sequence
  Description of Artificial Sequence: Synthetic oligonucleotide
ucuccgcccacugcaagaa

SEQ ID NO: 11872 - RNA, 19 nt, Artificial Sequence
  Description of Artificial Sequence: Synthetic oligonucleotide
ugcuccgcccacugcaaga

SEQ ID NO: 11873 - RNA, 19 nt, Artificial Sequence
  Description of Artificial Sequence: Synthetic oligonucleotide
uggcuccgcccacugcaag

SEQ ID NO: 11874 - RNA, 19 nt, Artificial Sequence
  Description of Artificial Sequence: Synthetic oligonucleotide
ugggcuccgcccacugcaa

SEQ ID NO: 11875 - RNA, 19 nt, Artificial Sequence
  Description of Artificial Sequence: Synthetic oligonucleotide
uugggcuccgcccacugca

SEQ ID NO: 11876 - RNA, 19 nt, Artificial Sequence
  Description of Artificial Sequence: Synthetic oligonucleotide
uaugggcuccgcccacugc

SEQ ID NO: 11877 - RNA, 19 nt, Artificial Sequence
  Description of Artificial Sequence: Synthetic oligonucleotide
ugaugggcuccgcccacug

SEQ ID NO: 11878 - RNA, 19 nt, Artificial Sequence
  Description of Artificial Sequence: Synthetic oligonucleotide
ucgaugggcuccgcccacu

SEQ ID NO: 11879 - RNA, 19 nt, Artificial Sequence
  Description of Artificial Sequence: Synthetic oligonucleotide
uacgaugggcuccgcccac

SEQ ID NO: 11880 - RNA, 19 nt, Artificial Sequence
  Description of Artificial Sequence: Synthetic oligonucleotide
ucacgaugggcuccgccca

SEQ ID NO: 11881 - RNA, 19 nt, Artificial Sequence
  Description of Artificial Sequence: Synthetic oligonucleotide
uccacgaugggcuccgccc

SEQ ID NO: 11882 - RNA, 19 nt, Artificial Sequence
  Description of Artificial Sequence: Synthetic oligonucleotide
uaccacgaugggcuccgcc

SEQ ID NO: 11883 - RNA, 19 nt, Artificial Sequence
  Description of Artificial Sequence: Synthetic oligonucleotide
ucaccacgaugggcuccgc

SEQ ID NO: 11884 - RNA, 19 nt, Artificial Sequence
  Description of Artificial Sequence: Synthetic oligonucleotide
uucaccacgaugggcuccg

SEQ ID NO: 11885 - RNA, 19 nt, Artificial Sequence
  Description of Artificial Sequence: Synthetic oligonucleotide
ucucaccacgaugggcucc

SEQ ID NO: 11886 - RNA, 19 nt, Artificial Sequence
  Description of Artificial Sequence: Synthetic oligonucleotide
uccucaccacgaugggcuc

SEQ ID NO: 11887 - RNA, 19 nt, Artificial Sequence
  Description of Artificial Sequence: Synthetic oligonucleotide
ugccucaccacgaugggcu

SEQ ID NO: 11888 - RNA, 19 nt, Artificial Sequence
  Description of Artificial Sequence: Synthetic oligonucleotide
uagccucaccacgaugggc

SEQ ID NO: 11889 - RNA, 19 nt, Artificial Sequence
  Description of Artificial Sequence: Synthetic oligonucleotide
uaagccucaccacgauggg

SEQ ID NO: 11890 - RNA, 19 nt, Artificial Sequence
  Description of Artificial Sequence: Synthetic oligonucleotide
uuaagccucaccacgaugg

SEQ ID NO: 11891 - RNA, 19 nt, Artificial Sequence
  Description of Artificial Sequence: Synthetic oligonucleotide
uuuaagccucaccacgaug

SEQ ID NO: 11892 - RNA, 19 nt, Artificial Sequence
  Description of Artificial Sequence: Synthetic oligonucleotide
ucuuaagccucaccacgau

SEQ ID NO: 11893 - RNA, 19 nt, Artificial Sequence
  Description of Artificial Sequence: Synthetic oligonucleotide
uccuuaagccucaccacga

SEQ ID NO: 11894 - RNA, 19 nt, Artificial Sequence
  Description of Artificial Sequence: Synthetic oligonucleotide
uuccuuaagccucaccacg

SEQ ID NO: 11895 - RNA, 19 nt, Artificial Sequence
  Description of Artificial Sequence: Synthetic oligonucleotide
ucuccuuaagccucaccac

SEQ ID NO: 11896 - RNA, 19 nt, Artificial Sequence
  Description of Artificial Sequence: Synthetic oligonucleotide
uccuccuuaagccucacca

SEQ ID NO: 11897 - RNA, 19 nt, Artificial Sequence
  Description of Artificial Sequence: Synthetic oligonucleotide
uaccuccuuaagccucacc

SEQ ID NO: 11898 - RNA, 19 nt, Artificial Sequence
  Description of Artificial Sequence: Synthetic oligonucleotide
ugaccuccuuaagccucac

SEQ ID NO: 11899 - RNA, 19 nt, Artificial Sequence
  Description of Artificial Sequence: Synthetic oligonucleotide
uggaccuccuuaagccuca

SEQ ID NO: 11900 - RNA, 19 nt, Artificial Sequence
  Description of Artificial Sequence: Synthetic oligonucleotide
ucggaccuccuuaagccuc

SEQ ID NO: 11901 - RNA, 19 nt, Artificial Sequence
  Description of Artificial Sequence: Synthetic oligonucleotide
uucggaccuccuuaagccu

SEQ ID NO: 11902 - RNA, 19 nt, Artificial Sequence
  Description of Artificial Sequence: Synthetic oligonucleotide
ugucggaccuccuuaagcc

SEQ ID NO: 11903 - RNA, 19 nt, Artificial Sequence
  Description of Artificial Sequence: Synthetic oligonucleotide
uagucggaccuccuuaagc

SEQ ID NO: 11904 - RNA, 19 nt, Artificial Sequence
  Description of Artificial Sequence: Synthetic oligonucleotide
ucagucggaccuccuuaag

SEQ ID NO: 11905 - RNA, 19 nt, Artificial Sequence
  Description of Artificial Sequence: Synthetic oligonucleotide
ugcagucggaccuccuuaa

SEQ ID NO: 11906 - RNA, 19 nt, Artificial Sequence
  Description of Artificial Sequence: Synthetic oligonucleotide
uugcagucggaccuccuua

SEQ ID NO: 11907 - RNA, 19 nt, Artificial Sequence
  Description of Artificial Sequence: Synthetic oligonucleotide
ucugcagucggaccuccuu

SEQ ID NO: 11908 - RNA, 19 nt, Artificial Sequence
  Description of Artificial Sequence: Synthetic oligonucleotide
uucugcagucggaccuccu

SEQ ID NO: 11909 - RNA, 19 nt, Artificial Sequence
  Description of Artificial Sequence: Synthetic oligonucleotide
ucucugcagucggaccucc

SEQ ID NO: 11910 - RNA, 19 nt, Artificial Sequence
  Description of Artificial Sequence: Synthetic oligonucleotide
uccucugcagucggaccuc

SEQ ID NO: 11911 - RNA, 19 nt, Artificial Sequence
  Description of Artificial Sequence: Synthetic oligonucleotide
ucccucugcagucggaccu

SEQ ID NO: 11912 - RNA, 19 nt, Artificial Sequence
  Description of Artificial Sequence: Synthetic oligonucleotide
uucccucugcagucggacc

SEQ ID NO: 11913 - RNA, 19 nt, Artificial Sequence
  Description of Artificial Sequence: Synthetic oligonucleotide
ugucccucugcagucggac

SEQ ID NO: 11914 - RNA, 19 nt, Artificial Sequence
  Description of Artificial Sequence: Synthetic oligonucleotide
ucgucccucugcagucgga

SEQ ID NO: 11915 - RNA, 19 nt, Artificial Sequence
  Description of Artificial Sequence: Synthetic oligonucleotide
uucgucccucugcagucgg

SEQ ID NO: 11916 - RNA, 19 nt, Artificial Sequence
  Description of Artificial Sequence: Synthetic oligonucleotide
ugucgucccucugcagucg

SEQ ID NO: 11917 - RNA, 19 nt, Artificial Sequence
  Description of Artificial Sequence: Synthetic oligonucleotide
uagucgucccucugcaguc

SEQ ID NO: 11918 - RNA, 19 nt, Artificial Sequence
  Description of Artificial Sequence: Synthetic oligonucleotide
uaagucgucccucugcagu

SEQ ID NO: 11919 - RNA, 19 nt, Artificial Sequence
  Description of Artificial Sequence: Synthetic oligonucleotide
ugaagucgucccucugcag

SEQ ID NO: 11920 - RNA, 19 nt, Artificial Sequence
  Description of Artificial Sequence: Synthetic oligonucleotide
ucgaagucgucccucugca

SEQ ID NO: 11921 - RNA, 19 nt, Artificial Sequence
  Description of Artificial Sequence: Synthetic oligonucleotide
uucgaagucgucccucugc

SEQ ID NO: 11922 - RNA, 19 nt, Artificial Sequence
  Description of Artificial Sequence: Synthetic oligonucleotide
ucucgaagucgucccucug

SEQ ID NO: 11923 - RNA, 19 nt, Artificial Sequence
  Description of Artificial Sequence: Synthetic oligonucleotide
uucucgaagucgucccucu

SEQ ID NO: 11924 - RNA, 19 nt, Artificial Sequence
  Description of Artificial Sequence: Synthetic oligonucleotide
uaucucgaagucgucccuc

SEQ ID NO: 11925 - RNA, 19 nt, Artificial Sequence
  Description of Artificial Sequence: Synthetic oligonucleotide
uaaucucgaagucgucccu

SEQ ID NO: 11926 - RNA, 19 nt, Artificial Sequence
  Description of Artificial Sequence: Synthetic oligonucleotide
ugaaucucgaagucguccc

SEQ ID NO: 11927 - RNA, 19 nt, Artificial Sequence
  Description of Artificial Sequence: Synthetic oligonucleotide
uagaaucucgaagucgucc

SEQ ID NO: 11928 - RNA, 19 nt, Artificial Sequence
  Description of Artificial Sequence: Synthetic oligonucleotide
ucagaaucucgaagucguc

SEQ ID NO: 11929 - RNA, 19 nt, Artificial Sequence
  Description of Artificial Sequence: Synthetic oligonucleotide
uucagaaucucgaagucgu

SEQ ID NO: 11930 - RNA, 19 nt, Artificial Sequence
  Description of Artificial Sequence: Synthetic oligonucleotide
uuucagaaucucgaagucg

SEQ ID NO: 11931 - RNA, 19 nt, Artificial Sequence
  Description of Artificial Sequence: Synthetic oligonucleotide
ucuucagaaucucgaaguc

SEQ ID NO: 11932 - RNA, 19 nt, Artificial Sequence
  Description of Artificial Sequence: Synthetic oligonucleotide
uccuucagaaucucgaagu

SEQ ID NO: 11933 - RNA, 19 nt, Artificial Sequence
  Description of Artificial Sequence: Synthetic oligonucleotide
uaccuucagaaucucgaag

SEQ ID NO: 11934 - RNA, 19 nt, Artificial Sequence
  Description of Artificial Sequence: Synthetic oligonucleotide
ucaccuucagaaucucgaa

SEQ ID NO: 11935 - RNA, 19 nt, Artificial Sequence
  Description of Artificial Sequence: Synthetic oligonucleotide
uucaccuucagaaucucga

SEQ ID NO: 11936 - RNA, 19 nt, Artificial Sequence
  Description of Artificial Sequence: Synthetic oligonucleotide
uaucaccuucagaaucucg

SEQ ID NO: 11937 - RNA, 19 nt, Artificial Sequence
  Description of Artificial Sequence: Synthetic oligonucleotide
ugaucaccuucagaaucuc

SEQ ID NO: 11938 - RNA, 19 nt, Artificial Sequence
  Description of Artificial Sequence: Synthetic oligonucleotide
ucgaucaccuucagaaucu

SEQ ID NO: 11939 - RNA, 19 nt, Artificial Sequence
  Description of Artificial Sequence: Synthetic oligonucleotide
uccgaucaccuucagaauc

SEQ ID NO: 11940 - RNA, 19 nt, Artificial Sequence
  Description of Artificial Sequence: Synthetic oligonucleotide
uuccgaucaccuucagaau

SEQ ID NO: 11941 - RNA, 19 nt, Artificial Sequence
  Description of Artificial Sequence: Synthetic oligonucleotide
uguccgaucaccuucagaa

SEQ ID NO: 11942 - RNA, 19 nt, Artificial Sequence
  Description of Artificial Sequence: Synthetic oligonucleotide
ucguccgaucaccuucaga

SEQ ID NO: 11943 - RNA, 19 nt, Artificial Sequence
  Description of Artificial Sequence: Synthetic oligonucleotide
ugcguccgaucaccuucag

SEQ ID NO: 11944 - RNA, 19 nt, Artificial Sequence
  Description of Artificial Sequence: Synthetic oligonucleotide
ucgcguccgaucaccuuca

SEQ ID NO: 11945 - RNA, 19 nt, Artificial Sequence
  Description of Artificial Sequence: Synthetic oligonucleotide
uccgcguccgaucaccuuc

SEQ ID NO: 11946 - RNA, 19 nt, Artificial Sequence
  Description of Artificial Sequence: Synthetic oligonucleotide
ucccgcguccgaucaccuu

SEQ ID NO: 11947 - RNA, 19 nt, Artificial Sequence
  Description of Artificial Sequence: Synthetic oligonucleotide
uccccgcguccgaucaccu

SEQ ID NO: 11948 - RNA, 19 nt, Artificial Sequence
  Description of Artificial Sequence: Synthetic oligonucleotide
ugccccgcguccgaucacc

SEQ ID NO: 11949 - RNA, 19 nt, Artificial Sequence
  Description of Artificial Sequence: Synthetic oligonucleotide
ucgccccgcguccgaucac

SEQ ID NO: 11950 - RNA, 19 nt, Artificial Sequence
  Description of Artificial Sequence: Synthetic oligonucleotide
uacgccccgcguccgauca

SEQ ID NO: 11951 - RNA, 19 nt, Artificial Sequence
  Description of Artificial Sequence: Synthetic oligonucleotide
uaacgccccgcguccgauc

SEQ ID NO: 11952 - RNA, 19 nt, Artificial Sequence
  Description of Artificial Sequence: Synthetic oligonucleotide
ugaacgccccgcguccgau

SEQ ID NO: 11953 - RNA, 19 nt, Artificial Sequence
  Description of Artificial Sequence: Synthetic oligonucleotide
uugaacgccccgcguccga

SEQ ID NO: 11954 - RNA, 19 nt, Artificial Sequence
  Description of Artificial Sequence: Synthetic oligonucleotide
ucugaacgccccgcguccg

SEQ ID NO: 11955 - RNA, 19 nt, Artificial Sequence
  Description of Artificial Sequence: Synthetic oligonucleotide
ugcugaacgccccgcgucc

SEQ ID NO: 11956 - RNA, 19 nt, Artificial Sequence
  Description of Artificial Sequence: Synthetic oligonucleotide
ucgcugaacgccccgcguc

SEQ ID NO: 11957 - RNA, 19 nt, Artificial Sequence
  Description of Artificial Sequence: Synthetic oligonucleotide
uucgcugaacgccccgcgu

SEQ ID NO: 11958 - RNA, 19 nt, Artificial Sequence
  Description of Artificial Sequence: Synthetic oligonucleotide
ucucgcugaacgccccgcg

SEQ ID NO: 11959 - RNA, 19 nt, Artificial Sequence
  Description of Artificial Sequence: Synthetic oligonucleotide
uccucgcugaacgccccgc

SEQ ID NO: 11960 - RNA, 19 nt, Artificial Sequence
  Description of Artificial Sequence: Synthetic oligonucleotide
uaccucgcugaacgccccg

SEQ ID NO: 11961 - RNA, 19 nt, Artificial Sequence
  Description of Artificial Sequence: Synthetic oligonucleotide
uuaccucgcugaacgcccc

SEQ ID NO: 11962 - RNA, 19 nt, Artificial Sequence
  Description of Artificial Sequence: Synthetic oligonucleotide
ucuaccucgcugaacgccc

SEQ ID NO: 11963 - RNA, 19 nt, Artificial Sequence
  Description of Artificial Sequence: Synthetic oligonucleotide
ugcuaccucgcugaacgcc

SEQ ID NO: 11964 - RNA, 19 nt, Artificial Sequence
  Description of Artificial Sequence: Synthetic oligonucleotide
ucgcuaccucgcugaacgc

SEQ ID NO: 11965 - RNA, 19 nt, Artificial Sequence
  Description of Artificial Sequence: Synthetic oligonucleotide
uccgcuaccucgcugaacg

SEQ ID NO: 11966 - RNA, 19 nt, Artificial Sequence
  Description of Artificial Sequence: Synthetic oligonucleotide
uaccgcuaccucgcugaac

SEQ ID NO: 11967 - RNA, 19 nt, Artificial Sequence
  Description of Artificial Sequence: Synthetic oligonucleotide
uuaccgcuaccucgcugaa

SEQ ID NO: 11968 - RNA, 19 nt, Artificial Sequence
  Description of Artificial Sequence: Synthetic oligonucleotide
ucuaccgcuaccucgcuga

SEQ ID NO: 11969 - RNA, 19 nt, Artificial Sequence
  Description of Artificial Sequence: Synthetic oligonucleotide
uacuaccgcuaccucgcug

SEQ ID NO: 11970 - RNA, 19 nt, Artificial Sequence
  Description of Artificial Sequence: Synthetic oligonucleotide
ucacuaccgcuaccucgcu

SEQ ID NO: 11971 - RNA, 19 nt, Artificial Sequence
  Description of Artificial Sequence: Synthetic oligonucleotide
uucacuaccgcuaccucgc

SEQ ID NO: 11972 - RNA, 19 nt, Artificial Sequence
  Description of Artificial Sequence: Synthetic oligonucleotide
uuucacuaccgcuaccucg

SEQ ID NO: 11973 - RNA, 19 nt, Artificial Sequence
  Description of Artificial Sequence: Synthetic oligonucleotide
ucuucacuaccgcuaccuc

SEQ ID NO: 11974 - RNA, 19 nt, Artificial Sequence
  Description of Artificial Sequence: Synthetic oligonucleotide
uucuucacuaccgcuaccu

SEQ ID NO: 11975 - RNA, 19 nt, Artificial Sequence
  Description of Artificial Sequence: Synthetic oligonucleotide
uaucuucacuaccgcuacc

SEQ ID NO: 11976 - RNA, 19 nt, Artificial Sequence
  Description of Artificial Sequence: Synthetic oligonucleotide
ucaucuucacuaccgcuac

SEQ ID NO: 11977 - RNA, 19 nt, Artificial Sequence
  Description of Artificial Sequence: Synthetic oligonucleotide
uucaucuucacuaccgcua

SEQ ID NO: 11978 - RNA, 19 nt, Artificial Sequence
  Description of Artificial Sequence: Synthetic oligonucleotide
uuucaucuucacuaccgcu

SEQ ID NO: 11979 - RNA, 19 nt, Artificial Sequence
  Description of Artificial Sequence: Synthetic oligonucleotide
ucuucaucuucacuaccgc

SEQ ID NO: 11980 - RNA, 19 nt, Artificial Sequence
  Description of Artificial Sequence: Synthetic oligonucleotide
ugcuucaucuucacuaccg

SEQ ID NO: 11981 - RNA, 19 nt, Artificial Sequence
  Description of Artificial Sequence: Synthetic oligonucleotide
uugcuucaucuucacuacc

SEQ ID NO: 11982 - RNA, 19 nt, Artificial Sequence
  Description of Artificial Sequence: Synthetic oligonucleotide
ucugcuucaucuucacuac

SEQ ID NO: 11983 - RNA, 19 nt, Artificial Sequence
  Description of Artificial Sequence: Synthetic oligonucleotide
uucugcuucaucuucacua

SEQ ID NO: 11984 - RNA, 19 nt, Artificial Sequence
  Description of Artificial Sequence: Synthetic oligonucleotide
ugucugcuucaucuucacu

SEQ ID NO: 11985 - RNA, 19 nt, Artificial Sequence
  Description of Artificial Sequence: Synthetic oligonucleotide
ucgucugcuucaucuucac

SEQ ID NO: 11986 - RNA, 19 nt, Artificial Sequence
  Description of Artificial Sequence: Synthetic oligonucleotide
uccgucugcuucaucuuca

SEQ ID NO: 11987 - RNA, 19 nt, Artificial Sequence
  Description of Artificial Sequence: Synthetic oligonucleotide
ucccgucugcuucaucuuc

SEQ ID NO: 11988 - RNA, 19 nt, Artificial Sequence
  Description of Artificial Sequence: Synthetic oligonucleotide
ugcccgucugcuucaucuu

SEQ ID NO: 11989 - RNA, 19 nt, Artificial Sequence
  Description of Artificial Sequence: Synthetic oligonucleotide
uggcccgucugcuucaucu

SEQ ID NO: 11990 - RNA, 19 nt, Artificial Sequence
  Description of Artificial Sequence: Synthetic oligonucleotide
uuggcccgucugcuucauc

SEQ ID NO: 11991 - RNA, 19 nt, Artificial Sequence
  Description of Artificial Sequence: Synthetic oligonucleotide
ucuggcccgucugcuucau

SEQ ID NO: 11992 - RNA, 19 nt, Artificial Sequence
  Description of Artificial Sequence: Synthetic oligonucleotide
uccuggcccgucugcuuca

SEQ ID NO: 11993 - RNA, 19 nt, Artificial Sequence
  Description of Artificial Sequence: Synthetic oligonucleotide
uaccuggcccgucugcuuc

SEQ ID NO: 11994 - RNA, 19 nt, Artificial Sequence
  Description of Artificial Sequence: Synthetic oligonucleotide
ucaccuggcccgucugcuu

SEQ ID NO: 11995 - RNA, 19 nt, Artificial Sequence
  Description of Artificial Sequence: Synthetic oligonucleotide
uacaccuggcccgucugcu

SEQ ID NO: 11996 - RNA, 19 nt, Artificial Sequence
  Description of Artificial Sequence: Synthetic oligonucleotide
uuacaccuggcccgucugc

SEQ ID NO: 11997 - RNA, 19 nt, Artificial Sequence
  Description of Artificial Sequence: Synthetic oligonucleotide
uauacaccuggcccgucug

SEQ ID NO: 11998 - RNA, 19 nt, Artificial Sequence
  Description of Artificial Sequence: Synthetic oligonucleotide
ucauacaccuggcccgucu

SEQ ID NO: 11999 - RNA, 19 nt, Artificial Sequence
  Description of Artificial Sequence: Synthetic oligonucleotide
ugcauacaccuggcccguc

SEQ ID NO: 12000 - RNA, 19 nt, Artificial Sequence
  Description of Artificial Sequence: Synthetic oligonucleotide
uggcauacaccuggcccgu

SEQ ID NO: 12001 - RNA, 19 nt, Artificial Sequence
  Description of Artificial Sequence: Synthetic oligonucleotide
uuggcauacaccuggcccg

SEQ ID NO: 12002 - RNA, 19 nt, Artificial Sequence
  Description of Artificial Sequence: Synthetic oligonucleotide
uauggcauacaccuggccc

SEQ ID NO: 12003 - RNA, 19 nt, Artificial Sequence
  Description of Artificial Sequence: Synthetic oligonucleotide
ucauggcauacaccuggcc

SEQ ID NO: 12004 - RNA, 19 nt, Artificial Sequence
  Description of Artificial Sequence: Synthetic oligonucleotide
uucauggcauacaccuggc

SEQ ID NO: 12005 - RNA, 19 nt, Artificial Sequence
  Description of Artificial Sequence: Synthetic oligonucleotide
uuucauggcauacaccugg

SEQ ID NO: 12006 - RNA, 19 nt, Artificial Sequence
  Description of Artificial Sequence: Synthetic oligonucleotide
ucuucauggcauacaccug

SEQ ID NO: 12007 - RNA, 19 nt, Artificial Sequence
  Description of Artificial Sequence: Synthetic oligonucleotide
uucuucauggcauacaccu

SEQ ID NO: 12008 - RNA, 19 nt, Artificial Sequence
  Description of Artificial Sequence: Synthetic oligonucleotide
uaucuucauggcauacacc

SEQ ID NO: 12009 - RNA, 19 nt, Artificial Sequence
  Description of Artificial Sequence: Synthetic oligonucleotide
ugaucuucauggcauacac

SEQ ID NO: 12010 - RNA, 19 nt, Artificial Sequence
  Description of Artificial Sequence: Synthetic oligonucleotide
uugaucuucauggcauaca

SEQ ID NO: 12011 - RNA, 19 nt, Artificial Sequence
  Description of Artificial Sequence: Synthetic oligonucleotide
uaugaucuucauggcauac

SEQ ID NO: 12012 - RNA, 19 nt, Artificial Sequence
  Description of Artificial Sequence: Synthetic oligonucleotide
ucaugaucuucauggcaua

SEQ ID NO: 12013 - RNA, 19 nt, Artificial Sequence
  Description of Artificial Sequence: Synthetic oligonucleotide
uucaugaucuucauggcau

SEQ ID NO: 12014 - RNA, 19 nt, Artificial Sequence
  Description of Artificial Sequence: Synthetic oligonucleotide
uuucaugaucuucauggca

SEQ ID NO: 12015 - RNA, 19 nt, Artificial Sequence
  Description of Artificial Sequence: Synthetic oligonucleotide
uguucaugaucuucauggc

SEQ ID NO: 12016 - RNA, 19 nt, Artificial Sequence
  Description of Artificial Sequence: Synthetic oligonucleotide
uuguucaugaucuucaugg

SEQ ID NO: 12017 - RNA, 19 nt, Artificial Sequence
  Description of Artificial Sequence: Synthetic oligonucleotide
uuuguucaugaucuucaug

SEQ ID NO: 12018 - RNA, 19 nt, Artificial Sequence
  Description of Artificial Sequence: Synthetic oligonucleotide
ucuuguucaugaucuucau

SEQ ID NO: 12019 - RNA, 19 nt, Artificial Sequence
  Description of Artificial Sequence: Synthetic oligonucleotide
uacuuguucaugaucuuca

SEQ ID NO: 12020 - RNA, 19 nt, Artificial Sequence
  Description of Artificial Sequence: Synthetic oligonucleotide
ucacuuguucaugaucuuc

SEQ ID NO: 12021 - RNA, 19 nt, Artificial Sequence
  Description of Artificial Sequence: Synthetic oligonucleotide
uccacuuguucaugaucuu

SEQ ID NO: 12022 - RNA, 19 nt, Artificial Sequence
  Description of Artificial Sequence: Synthetic oligonucleotide
ucccacuuguucaugaucu

SEQ ID NO: 12023 - RNA, 19 nt, Artificial Sequence
  Description of Artificial Sequence: Synthetic oligonucleotide
uucccacuuguucaugauc

SEQ ID NO: 12024 - RNA, 19 nt, Artificial Sequence
  Description of Artificial Sequence: Synthetic oligonucleotide
ugucccacuuguucaugau

SEQ ID NO: 12025 - RNA, 19 nt, Artificial Sequence
  Description of Artificial Sequence: Synthetic oligonucleotide
uugucccacuuguucauga

SEQ ID NO: 12026 - RNA, 19 nt, Artificial Sequence
  Description of Artificial Sequence: Synthetic oligonucleotide
uaugucccacuuguucaug

SEQ ID NO: 12027 - RNA, 19 nt, Artificial Sequence
  Description of Artificial Sequence: Synthetic oligonucleotide
ucaugucccacuuguucau

SEQ ID NO: 12028 - RNA, 19 nt, Artificial Sequence
  Description of Artificial Sequence: Synthetic oligonucleotide
ugcaugucccacuuguuca

SEQ ID NO: 12029 - RNA, 19 nt, Artificial Sequence
  Description of Artificial Sequence: Synthetic oligonucleotide
uagcaugucccacuuguuc

SEQ ID NO: 12030 - RNA, 19 nt, Artificial Sequence
  Description of Artificial Sequence: Synthetic oligonucleotide
ucagcaugucccacuuguu

SEQ ID NO: 12031 - RNA, 19 nt, Artificial Sequence
  Description of Artificial Sequence: Synthetic oligonucleotide
uucagcaugucccacuugu

SEQ ID NO: 12032 - RNA, 19 nt, Artificial Sequence
  Description of Artificial Sequence: Synthetic oligonucleotide
uuucagcaugucccacuug

SEQ ID NO: 12033 - RNA, 19 nt, Artificial Sequence
  Description of Artificial Sequence: Synthetic oligonucleotide
ucuucagcaugucccacuu

SEQ ID NO: 12034 - RNA, 19 nt, Artificial Sequence
  Description of Artificial Sequence: Synthetic oligonucleotide
uucuucagcaugucccacu

SEQ ID NO: 12035 - RNA, 19 nt, Artificial Sequence
  Description of Artificial Sequence: Synthetic oligonucleotide
ucucuucagcaugucccac

SEQ ID NO: 12036 - RNA, 19 nt, Artificial Sequence
  Description of Artificial Sequence: Synthetic oligonucleotide
uccucuucagcauguccca

SEQ ID NO: 12037 - RNA, 19 nt, Artificial Sequence
  Description of Artificial Sequence: Synthetic oligonucleotide
ucccucuucagcauguccc

SEQ ID NO: 12038 - RNA, 19 nt, Artificial Sequence
  Description of Artificial Sequence: Synthetic oligonucleotide
uccccucuucagcaugucc

SEQ ID NO: 12039 - RNA, 19 nt, Artificial Sequence
  Description of Artificial Sequence: Synthetic oligonucleotide
ugccccucuucagcauguc

SEQ ID NO: 12040 - RNA, 19 nt, Artificial Sequence
  Description of Artificial Sequence: Synthetic oligonucleotide
ucgccccucuucagcaugu

SEQ ID NO: 12041 - RNA, 19 nt, Artificial Sequence
  Description of Artificial Sequence: Synthetic oligonucleotide
uucgccccucuucagcaug

SEQ ID NO: 12042 - RNA, 19 nt, Artificial Sequence
  Description of Artificial Sequence: Synthetic oligonucleotide
ucucgccccucuucagcau

SEQ ID NO: 12043 - RNA, 19 nt, Artificial Sequence
  Description of Artificial Sequence: Synthetic oligonucleotide
uccucgccccucuucagca

SEQ ID NO: 12044 - RNA, 19 nt, Artificial Sequence
  Description of Artificial Sequence: Synthetic oligonucleotide
uaccucgccccucuucagc

SEQ ID NO: 12045 - RNA, 19 nt, Artificial Sequence
  Description of Artificial Sequence: Synthetic oligonucleotide
ucaccucgccccucuucag

SEQ ID NO: 12046 - RNA, 19 nt, Artificial Sequence
  Description of Artificial Sequence: Synthetic oligonucleotide
uacaccucgccccucuuca

SEQ ID NO: 12047 - RNA, 19 nt, Artificial Sequence
  Description of Artificial Sequence: Synthetic oligonucleotide
ugacaccucgccccucuuc

SEQ ID NO: 12048 - RNA, 19 nt, Artificial Sequence
  Description of Artificial Sequence: Synthetic oligonucleotide
ucgacaccucgccccucuu

SEQ ID NO: 12049 - RNA, 19 nt, Artificial Sequence
  Description of Artificial Sequence: Synthetic oligonucleotide
uacgacaccucgccccucu

SEQ ID NO: 12050 - RNA, 19 nt, Artificial Sequence
  Description of Artificial Sequence: Synthetic oligonucleotide
ucacgacaccucgccccuc

SEQ ID NO: 12051 - RNA, 19 nt, Artificial Sequence
  Description of Artificial Sequence: Synthetic oligonucleotide
ugcacgacaccucgccccu

SEQ ID NO: 12052 - RNA, 19 nt, Artificial Sequence
  Description of Artificial Sequence: Synthetic oligonucleotide
uagcacgacaccucgcccc

SEQ ID NO: 12053 - RNA, 19 nt, Artificial Sequence
  Description of Artificial Sequence: Synthetic oligonucleotide
uaagcacgacaccucgccc

SEQ ID NO: 12054 - RNA, 19 nt, Artificial Sequence
  Description of Artificial Sequence: Synthetic oligonucleotide
ugaagcacgacaccucgcc

SEQ ID NO: 12055 - RNA, 19 nt, Artificial Sequence
  Description of Artificial Sequence: Synthetic oligonucleotide
uggaagcacgacaccucgc

SEQ ID NO: 12056 - RNA, 19 nt, Artificial Sequence
  Description of Artificial Sequence: Synthetic oligonucleotide
ucggaagcacgacaccucg

SEQ ID NO: 12057 - RNA, 19 nt, Artificial Sequence
  Description of Artificial Sequence: Synthetic oligonucleotide
uacggaagcacgacaccuc

SEQ ID NO: 12058 - RNA, 19 nt, Artificial Sequence
  Description of Artificial Sequence: Synthetic oligonucleotide
ucacggaagcacgacaccu

SEQ ID NO: 12059 - RNA, 19 nt, Artificial Sequence
  Description of Artificial Sequence: Synthetic oligonucleotide
uucacggaagcacgacacc

SEQ ID NO: 12060 - RNA, 19 nt, Artificial Sequence
  Description of Artificial Sequence: Synthetic oligonucleotide
ucucacggaagcacgacac

SEQ ID NO: 12061 - RNA, 19 nt, Artificial Sequence
  Description of Artificial Sequence: Synthetic oligonucleotide
uccucacggaagcacgaca

SEQ ID NO: 12062 - RNA, 19 nt, Artificial Sequence
  Description of Artificial Sequence: Synthetic oligonucleotide
uuccucacggaagcacgac

SEQ ID NO: 12063 - RNA, 19 nt, Artificial Sequence
  Description of Artificial Sequence: Synthetic oligonucleotide
ucuccucacggaagcacga

SEQ ID NO: 12064 - RNA, 19 nt, Artificial Sequence
  Description of Artificial Sequence: Synthetic oligonucleotide
uucuccucacggaagcacg

SEQ ID NO: 12065 - RNA, 19 nt, Artificial Sequence
  Description of Artificial Sequence: Synthetic oligonucleotide
ucucuccucacggaagcac

SEQ ID NO: 12066 - RNA, 19 nt, Artificial Sequence
  Description of Artificial Sequence: Synthetic oligonucleotide
uccucuccucacggaagca

SEQ ID NO: 12067 - RNA, 19 nt, Artificial Sequence
  Description of Artificial Sequence: Synthetic oligonucleotide
ucccucuccucacggaagc

SEQ ID NO: 12068 - RNA, 19 nt, Artificial Sequence
  Description of Artificial Sequence: Synthetic oligonucleotide
uucccucuccucacggaag

SEQ ID NO: 12069 - RNA, 19 nt, Artificial Sequence
  Description of Artificial Sequence: Synthetic oligonucleotide
ugucccucuccucacggaa

SEQ ID NO: 12070 - RNA, 19 nt, Artificial Sequence
  Description of Artificial Sequence: Synthetic oligonucleotide
ucgucccucuccucacgga

SEQ ID NO: 12071 - RNA, 19 nt, Artificial Sequence
  Description of Artificial Sequence: Synthetic oligonucleotide
uacgucccucuccucacgg

SEQ ID NO: 12072 - RNA, 19 nt, Artificial Sequence
  Description of Artificial Sequence: Synthetic oligonucleotide
ucacgucccucuccucacg

SEQ ID NO: 12073 - RNA, 19 nt, Artificial Sequence
  Description of Artificial Sequence: Synthetic oligonucleotide
uacacgucccucuccucac

SEQ ID NO: 12074 - RNA, 19 nt, Artificial Sequence
  Description of Artificial Sequence: Synthetic oligonucleotide
uaacacgucccucuccuca

SEQ ID NO: 12075 - RNA, 19 nt, Artificial Sequence
  Description of Artificial Sequence: Synthetic oligonucleotide
ucaacacgucccucuccuc

SEQ ID NO: 12076 - RNA, 19 nt, Artificial Sequence
  Description of Artificial Sequence: Synthetic oligonucleotide
uccaacacgucccucuccu

SEQ ID NO: 12077 - RNA, 19 nt, Artificial Sequence
  Description of Artificial Sequence: Synthetic oligonucleotide
uaccaacacgucccucucc

SEQ ID NO: 12078 - RNA, 19 nt, Artificial Sequence
  Description of Artificial Sequence: Synthetic oligonucleotide
ucaccaacacgucccucuc

SEQ ID NO: 12079 - RNA, 19 nt, Artificial Sequence
  Description of Artificial Sequence: Synthetic oligonucleotide
uucaccaacacgucccucu

SEQ ID NO: 12080 - RNA, 19 nt, Artificial Sequence
  Description of Artificial Sequence: Synthetic oligonucleotide
uuucaccaacacgucccuc

SEQ ID NO: 12081 - RNA, 19 nt, Artificial Sequence
  Description of Artificial Sequence: Synthetic oligonucleotide
uauucaccaacacgucccu

SEQ ID NO: 12082 - RNA, 19 nt, Artificial Sequence
  Description of Artificial Sequence: Synthetic oligonucleotide
ucauucaccaacacguccc

SEQ ID NO: 12083 - RNA, 19 nt, Artificial Sequence
  Description of Artificial Sequence: Synthetic oligonucleotide
uccauucaccaacacgucc

SEQ ID NO: 12084 - RNA, 19 nt, Artificial Sequence
  Description of Artificial Sequence: Synthetic oligonucleotide
ucccauucaccaacacguc

SEQ ID NO: 12085 - RNA, 19 nt, Artificial Sequence
  Description of Artificial Sequence: Synthetic oligonucleotide
uccccauucaccaacacgu

SEQ ID NO: 12086 - RNA, 19 nt, Artificial Sequence
  Description of Artificial Sequence: Synthetic oligonucleotide
uuccccauucaccaacacg

SEQ ID NO: 12087 - RNA, 19 nt, Artificial Sequence
  Description of Artificial Sequence: Synthetic oligonucleotide
uguccccauucaccaacac

SEQ ID NO: 12088 - RNA, 19 nt, Artificial Sequence
  Description of Artificial Sequence: Synthetic oligonucleotide
ugguccccauucaccaaca

SEQ ID NO: 12089 - RNA, 19 nt, Artificial Sequence
  Description of Artificial Sequence: Synthetic oligonucleotide
ucgguccccauucaccaac

SEQ ID NO: 12090 - RNA, 19 nt, Artificial Sequence
  Description of Artificial Sequence: Synthetic oligonucleotide
uccgguccccauucaccaa

SEQ ID NO: 12091 - RNA, 19 nt, Artificial Sequence
  Description of Artificial Sequence: Synthetic oligonucleotide
ugccgguccccauucacca

SEQ ID NO: 12092 - RNA, 19 nt, Artificial Sequence
  Description of Artificial Sequence: Synthetic oligonucleotide
ucgccgguccccauucacc

SEQ ID NO: 12093 - RNA, 19 nt, Artificial Sequence
  Description of Artificial Sequence: Synthetic oligonucleotide
uccgccgguccccauucac

SEQ ID NO: 12094 - RNA, 19 nt, Artificial Sequence
  Description of Artificial Sequence: Synthetic oligonucleotide
uaccgccgguccccauuca

SEQ ID NO: 12095 - RNA, 19 nt, Artificial Sequence
  Description of Artificial Sequence: Synthetic oligonucleotide
ucaccgccgguccccauuc

SEQ ID NO: 12096 - RNA, 19 nt, Artificial Sequence
  Description of Artificial Sequence: Synthetic oligonucleotide
uccaccgccgguccccauu

SEQ ID NO: 12097 - RNA, 19 nt, Artificial Sequence
  Description of Artificial Sequence: Synthetic oligonucleotide
uuccaccgccgguccccau

SEQ ID NO: 12098 - RNA, 19 nt, Artificial Sequence
  Description of Artificial Sequence: Synthetic oligonucleotide
uauccaccgccggucccca

SEQ ID NO: 12099 - RNA, 19 nt, Artificial Sequence
  Description of Artificial Sequence: Synthetic oligonucleotide
ugauccaccgccggucccc

SEQ ID NO: 12100 - RNA, 19 nt, Artificial Sequence
  Description of Artificial Sequence: Synthetic oligonucleotide
uugauccaccgccgguccc

SEQ ID NO: 12101 - RNA, 19 nt, Artificial Sequence
  Description of Artificial Sequence: Synthetic oligonucleotide
ugugauccaccgccggucc

SEQ ID NO: 12102 - RNA, 19 nt, Artificial Sequence
  Description of Artificial Sequence: Synthetic oligonucleotide
ucgugauccaccgccgguc

SEQ ID NO: 12103 - RNA, 19 nt, Artificial Sequence
  Description of Artificial Sequence: Synthetic oligonucleotide
ugcgugauccaccgccggu

SEQ ID NO: 12104 - RNA, 19 nt, Artificial Sequence
  Description of Artificial Sequence: Synthetic oligonucleotide
uugcgugauccaccgccgg

SEQ ID NO: 12105 - RNA, 19 nt, Artificial Sequence
  Description of Artificial Sequence: Synthetic oligonucleotide
ucugcgugauccaccgccg

SEQ ID NO: 12106 - RNA, 19 nt, Artificial Sequence
  Description of Artificial Sequence: Synthetic oligonucleotide
ugcugcgugauccaccgcc

SEQ ID NO: 12107 - RNA, 19 nt, Artificial Sequence
  Description of Artificial Sequence: Synthetic oligonucleotide
uagcugcgugauccaccgc

SEQ ID NO: 12108 - RNA, 19 nt, Artificial Sequence
  Description of Artificial Sequence: Synthetic oligonucleotide
ucagcugcgugauccaccg

SEQ ID NO: 12109 - RNA, 19 nt, Artificial Sequence
  Description of Artificial Sequence: Synthetic oligonucleotide
ugcagcugcgugauccacc

SEQ ID NO: 12110 - RNA, 19 nt, Artificial Sequence
  Description of Artificial Sequence: Synthetic oligonucleotide
uugcagcugcgugauccac

SEQ ID NO: 12111 - RNA, 19 nt, Artificial Sequence
  Description of Artificial Sequence: Synthetic oligonucleotide
ugugcagcugcgugaucca

SEQ ID NO: 12112 - RNA, 19 nt, Artificial Sequence
  Description of Artificial Sequence: Synthetic oligonucleotide
uagugcagcugcgugaucc

SEQ ID NO: 12113 - RNA, 19 nt, Artificial Sequence
  Description of Artificial Sequence: Synthetic oligonucleotide
uaagugcagcugcgugauc

SEQ ID NO: 12114 - RNA, 19 nt, Artificial Sequence
  Description of Artificial Sequence: Synthetic oligonucleotide
ugaagugcagcugcgugau

SEQ ID NO: 12115 - RNA, 19 nt, Artificial Sequence
  Description of Artificial Sequence: Synthetic oligonucleotide
ucgaagugcagcugcguga

SEQ ID NO: 12116 - RNA, 19 nt, Artificial Sequence
  Description of Artificial Sequence: Synthetic oligonucleotide
ugcgaagugcagcugcgug

SEQ ID NO: 12117 - RNA, 19 nt, Artificial Sequence
  Description of Artificial Sequence: Synthetic oligonucleotide
uggcgaagugcagcugcgu

SEQ ID NO: 12118 - RNA, 19 nt, Artificial Sequence
  Description of Artificial Sequence: Synthetic oligonucleotide
uaggcgaagugcagcugcg

SEQ ID NO: 12119 - RNA, 19 nt, Artificial Sequence
  Description of Artificial Sequence: Synthetic oligonucleotide
uaaggcgaagugcagcugc

SEQ ID NO: 12120 - RNA, 19 nt, Artificial Sequence
  Description of Artificial Sequence: Synthetic oligonucleotide
ugaaggcgaagugcagcug

SEQ ID NO: 12121 - RNA, 19 nt, Artificial Sequence
  Description of Artificial Sequence: Synthetic oligonucleotide
uggaaggcgaagugcagcu

SEQ ID NO: 12122 - RNA, 19 nt, Artificial Sequence
  Description of Artificial Sequence: Synthetic oligonucleotide
uuggaaggcgaagugcagc

SEQ ID NO: 12123 - RNA, 19 nt, Artificial Sequence
  Description of Artificial Sequence: Synthetic oligonucleotide
ucuggaaggcgaagugcag

SEQ ID NO: 12124 - RNA, 19 nt, Artificial Sequence
  Description of Artificial Sequence: Synthetic oligonucleotide
uccuggaaggcgaagugca

SEQ ID NO: 12125 - RNA, 19 nt, Artificial Sequence
  Description of Artificial Sequence: Synthetic oligonucleotide
uuccuggaaggcgaagugc

SEQ ID NO: 12126 - RNA, 19 nt, Artificial Sequence
  Description of Artificial Sequence: Synthetic oligonucleotide
uauccuggaaggcgaagug

SEQ ID NO: 12127 - RNA, 19 nt, Artificial Sequence
  Description of Artificial Sequence: Synthetic oligonucleotide
ucauccuggaaggcgaagu

SEQ ID NO: 12128 - RNA, 19 nt, Artificial Sequence
  Description of Artificial Sequence: Synthetic oligonucleotide
uucauccuggaaggcgaag

SEQ ID NO: 12129 - RNA, 19 nt, Artificial Sequence
  Description of Artificial Sequence: Synthetic oligonucleotide
ucucauccuggaaggcgaa

SEQ ID NO: 12130 - RNA, 19 nt, Artificial Sequence
  Description of Artificial Sequence: Synthetic oligonucleotide
uucucauccuggaaggcga

SEQ ID NO: 12131 - RNA, 19 nt, Artificial Sequence
  Description of Artificial Sequence: Synthetic oligonucleotide
uuucucauccuggaaggcg

SEQ ID NO: 12132 - RNA, 19 nt, Artificial Sequence
  Description of Artificial Sequence: Synthetic oligonucleotide
uguucucauccuggaaggc

SEQ ID NO: 12133 - RNA, 19 nt, Artificial Sequence
  Description of Artificial Sequence: Synthetic oligonucleotide
uaguucucauccuggaagg

SEQ ID NO: 12134 - RNA, 19 nt, Artificial Sequence
  Description of Artificial Sequence: Synthetic oligonucleotide
uuaguucucauccuggaag

SEQ ID NO: 12135 - RNA, 19 nt, Artificial Sequence
  Description of Artificial Sequence: Synthetic oligonucleotide
uguaguucucauccuggaa

SEQ ID NO: 12136 - RNA, 19 nt, Artificial Sequence
  Description of Artificial Sequence: Synthetic oligonucleotide
ugguaguucucauccugga

SEQ ID NO: 12137 - RNA, 19 nt, Artificial Sequence
  Description of Artificial Sequence: Synthetic oligonucleotide
uagguaguucucauccugg

SEQ ID NO: 12138 - RNA, 19 nt, Artificial Sequence
  Description of Artificial Sequence: Synthetic oligonucleotide
ucagguaguucucauccug

SEQ ID NO: 12139 - RNA, 19 nt, Artificial Sequence
  Description of Artificial Sequence: Synthetic oligonucleotide
uacagguaguucucauccu

SEQ ID NO: 12140 - RNA, 19 nt, Artificial Sequence
  Description of Artificial Sequence: Synthetic oligonucleotide
uuacagguaguucucaucc

SEQ ID NO: 12141 - RNA, 19 nt, Artificial Sequence
  Description of Artificial Sequence: Synthetic oligonucleotide
uguacagguaguucucauc

SEQ ID NO: 12142 - RNA, 19 nt, Artificial Sequence
  Description of Artificial Sequence: Synthetic oligonucleotide
ugguacagguaguucucau

SEQ ID NO: 12143 - RNA, 19 nt, Artificial Sequence
  Description of Artificial Sequence: Synthetic oligonucleotide
uagguacagguaguucuca

SEQ ID NO: 12144 - RNA, 19 nt, Artificial Sequence
  Description of Artificial Sequence: Synthetic oligonucleotide
ucagguacagguaguucuc

SEQ ID NO: 12145 - RNA, 19 nt, Artificial Sequence
  Description of Artificial Sequence: Synthetic oligonucleotide
uccagguacagguaguucu

SEQ ID NO: 12146 - RNA, 19 nt, Artificial Sequence
  Description of Artificial Sequence: Synthetic oligonucleotide
uaccagguacagguaguuc

SEQ ID NO: 12147 - RNA, 19 nt, Artificial Sequence
  Description of Artificial Sequence: Synthetic oligonucleotide
ugaccagguacagguaguu

SEQ ID NO: 12148 - RNA, 19 nt, Artificial Sequence
  Description of Artificial Sequence: Synthetic oligonucleotide
uugaccagguacagguagu

SEQ ID NO: 12149 - RNA, 19 nt, Artificial Sequence
  Description of Artificial Sequence: Synthetic oligonucleotide
uaugaccagguacagguag

SEQ ID NO: 12150 - RNA, 19 nt, Artificial Sequence
  Description of Artificial Sequence: Synthetic oligonucleotide
ucaugaccagguacaggua

SEQ ID NO: 12151 - RNA, 19 nt, Artificial Sequence
  Description of Artificial Sequence: Synthetic oligonucleotide
uccaugaccagguacaggu

SEQ ID NO: 12152 - RNA, 19 nt, Artificial Sequence
  Description of Artificial Sequence: Synthetic oligonucleotide
uuccaugaccagguacagg

SEQ ID NO: 12153 - RNA, 19 nt, Artificial Sequence
  Description of Artificial Sequence: Synthetic oligonucleotide
ucuccaugaccagguacag

SEQ ID NO: 12154 - RNA, 19 nt, Artificial Sequence
  Description of Artificial Sequence: Synthetic oligonucleotide
uacuccaugaccagguaca

SEQ ID NO: 12155 - RNA, 19 nt, Artificial Sequence
  Description of Artificial Sequence: Synthetic oligonucleotide
uuacuccaugaccagguac

SEQ ID NO: 12156 - RNA, 19 nt, Artificial Sequence
  Description of Artificial Sequence: Synthetic oligonucleotide
uauacuccaugaccaggua

SEQ ID NO: 12157 - RNA, 19 nt, Artificial Sequence
  Description of Artificial Sequence: Synthetic oligonucleotide
uaauacuccaugaccaggu

SEQ ID NO: 12158 - RNA, 19 nt, Artificial Sequence
  Description of Artificial Sequence: Synthetic oligonucleotide
uuaauacuccaugaccagg

SEQ ID NO: 12159 - RNA, 19 nt, Artificial Sequence
  Description of Artificial Sequence: Synthetic oligonucleotide
uguaauacuccaugaccag

SEQ ID NO: 12160 - RNA, 19 nt, Artificial Sequence
  Description of Artificial Sequence: Synthetic oligonucleotide
ucguaauacuccaugacca

SEQ ID NO: 12161 - RNA, 19 nt, Artificial Sequence
  Description of Artificial Sequence: Synthetic oligonucleotide
uacguaauacuccaugacc

SEQ ID NO: 12162 - RNA, 19 nt, Artificial Sequence
  Description of Artificial Sequence: Synthetic oligonucleotide
ucacguaauacuccaugac

SEQ ID NO: 12163 - RNA, 19 nt, Artificial Sequence
  Description of Artificial Sequence: Synthetic oligonucleotide
uccacguaauacuccauga

SEQ ID NO: 12164 - RNA, 19 nt, Artificial Sequence
  Description of Artificial Sequence: Synthetic oligonucleotide
ucccacguaauacuccaug

SEQ ID NO: 12165 - RNA, 19 nt, Artificial Sequence
  Description of Artificial Sequence: Synthetic oligonucleotide
ugcccacguaauacuccau

SEQ ID NO: 12166 - RNA, 19 nt, Artificial Sequence
  Description of Artificial Sequence: Synthetic oligonucleotide
ucgcccacguaauacucca

SEQ ID NO: 12167 - RNA, 19 nt, Artificial Sequence
  Description of Artificial Sequence: Synthetic oligonucleotide
uccgcccacguaauacucc

SEQ ID NO: 12168 - RNA, 19 nt, Artificial Sequence
  Description of Artificial Sequence: Synthetic oligonucleotide
ucccgcccacguaauacuc

SEQ ID NO: 12169 - RNA, 19 nt, Artificial Sequence
  Description of Artificial Sequence: Synthetic oligonucleotide
uccccgcccacguaauacu

SEQ ID NO: 12170 - RNA, 19 nt, Artificial Sequence
  Description of Artificial Sequence: Synthetic oligonucleotide
uuccccgcccacguaauac

SEQ ID NO: 12171 - RNA, 19 nt, Artificial Sequence
  Description of Artificial Sequence: Synthetic oligonucleotide
uguccccgcccacguaaua

SEQ ID NO: 12172 - RNA, 19 nt, Artificial Sequence
  Description of Artificial Sequence: Synthetic oligonucleotide
ugguccccgcccacguaau

SEQ ID NO: 12173 - RNA, 19 nt, Artificial Sequence
  Description of Artificial Sequence: Synthetic oligonucleotide
uagguccccgcccacguaa

SEQ ID NO: 12174 - RNA, 19 nt, Artificial Sequence
  Description of Artificial Sequence: Synthetic oligonucleotide
ucagguccccgcccacgua

SEQ ID NO: 12175 - RNA, 19 nt, Artificial Sequence
  Description of Artificial Sequence: Synthetic oligonucleotide
ugcagguccccgcccacgu

SEQ ID NO: 12176 - RNA, 19 nt, Artificial Sequence
  Description of Artificial Sequence: Synthetic oligonucleotide
uagcagguccccgcccacg

SEQ ID NO: 12177 - RNA, 19 nt, Artificial Sequence
  Description of Artificial Sequence: Synthetic oligonucleotide
ucagcagguccccgcccac

SEQ ID NO: 12178 - RNA, 19 nt, Artificial Sequence
  Description of Artificial Sequence: Synthetic oligonucleotide
uucagcagguccccgccca

SEQ ID NO: 12179 - RNA, 19 nt, Artificial Sequence
  Description of Artificial Sequence: Synthetic oligonucleotide
ugucagcagguccccgccc

SEQ ID NO: 12180 - RNA, 19 nt, Artificial Sequence
  Description of Artificial Sequence: Synthetic oligonucleotide
uugucagcagguccccgcc

SEQ ID NO: 12181 - RNA, 19 nt, Artificial Sequence
  Description of Artificial Sequence: Synthetic oligonucleotide
ugugucagcagguccccgc

SEQ ID NO: 12182 - RNA, 19 nt, Artificial Sequence
  Description of Artificial Sequence: Synthetic oligonucleotide
uagugucagcagguccccg

SEQ ID NO: 12183 - RNA, 19 nt, Artificial Sequence
  Description of Artificial Sequence: Synthetic oligonucleotide
ucagugucagcaggucccc

SEQ ID NO: 12184 - RNA, 19 nt, Artificial Sequence
  Description of Artificial Sequence: Synthetic oligonucleotide
ugcagugucagcagguccc

SEQ ID NO: 12185 - RNA, 19 nt, Artificial Sequence
  Description of Artificial Sequence: Synthetic oligonucleotide
uagcagugucagcaggucc

SEQ ID NO: 12186 - RNA, 19 nt, Artificial Sequence
  Description of Artificial Sequence: Synthetic oligonucleotide
ucagcagugucagcagguc

SEQ ID NO: 12187 - RNA, 19 nt, Artificial Sequence
  Description of Artificial Sequence: Synthetic oligonucleotide
uucagcagugucagcaggu

SEQ ID NO: 12188 - RNA, 19 nt, Artificial Sequence
  Description of Artificial Sequence: Synthetic oligonucleotide
ucucagcagugucagcagg

SEQ ID NO: 12189 - RNA, 19 nt, Artificial Sequence
  Description of Artificial Sequence: Synthetic oligonucleotide
ugcucagcagugucagcag

SEQ ID NO: 12190 - RNA, 19 nt, Artificial Sequence
  Description of Artificial Sequence: Synthetic oligonucleotide
uugcucagcagugucagca

SEQ ID NO: 12191 - RNA, 19 nt, Artificial Sequence
  Description of Artificial Sequence: Synthetic oligonucleotide
uuugcucagcagugucagc

SEQ ID NO: 12192 - RNA, 19 nt, Artificial Sequence
  Description of Artificial Sequence: Synthetic oligonucleotide
ucuugcucagcagugucag

SEQ ID NO: 12193 - RNA, 19 nt, Artificial Sequence
  Description of Artificial Sequence: Synthetic oligonucleotide
uacuugcucagcaguguca

SEQ ID NO: 12194 - RNA, 19 nt, Artificial Sequence
  Description of Artificial Sequence: Synthetic oligonucleotide
uaacuugcucagcaguguc

SEQ ID NO: 12195 - RNA, 19 nt, Artificial Sequence
  Description of Artificial Sequence: Synthetic oligonucleotide
uaaacuugcucagcagugu

SEQ ID NO: 12196 - RNA, 19 nt, Artificial Sequence
  Description of Artificial Sequence: Synthetic oligonucleotide
ucaaacuugcucagcagug

SEQ ID NO: 12197 - RNA, 19 nt, Artificial Sequence
  Description of Artificial Sequence: Synthetic oligonucleotide
uccaaacuugcucagcagu

SEQ ID NO: 12198 - RNA, 19 nt, Artificial Sequence
  Description of Artificial Sequence: Synthetic oligonucleotide
ucccaaacuugcucagcag

SEQ ID NO: 12199 - RNA, 19 nt, Artificial Sequence
  Description of Artificial Sequence: Synthetic oligonucleotide
uccccaaacuugcucagca

SEQ ID NO: 12200 - RNA, 19 nt, Artificial Sequence
  Description of Artificial Sequence: Synthetic oligonucleotide
uuccccaaacuugcucagc

SEQ ID NO: 12201 - RNA, 19 nt, Artificial Sequence
  Description of Artificial Sequence: Synthetic oligonucleotide
ucuccccaaacuugcucag

SEQ ID NO: 12202 - RNA, 19 nt, Artificial Sequence
  Description of Artificial Sequence: Synthetic oligonucleotide
ugcuccccaaacuugcuca

SEQ ID NO: 12203 - RNA, 19 nt, Artificial Sequence
  Description of Artificial Sequence: Synthetic oligonucleotide
ucgcuccccaaacuugcuc

SEQ ID NO: 12204 - RNA, 19 nt, Artificial Sequence
  Description of Artificial Sequence: Synthetic oligonucleotide
uccgcuccccaaacuugcu

SEQ ID NO: 12205 - RNA, 19 nt, Artificial Sequence
  Description of Artificial Sequence: Synthetic oligonucleotide
uuccgcuccccaaacuugc

SEQ ID NO: 12206 - RNA, 19 nt, Artificial Sequence
  Description of Artificial Sequence: Synthetic oligonucleotide
uauccgcuccccaaacuug

SEQ ID NO: 12207 - RNA, 19 nt, Artificial Sequence
  Description of Artificial Sequence: Synthetic oligonucleotide
uaauccgcuccccaaacuu

SEQ ID NO: 12208 - RNA, 19 nt, Artificial Sequence
  Description of Artificial Sequence: Synthetic oligonucleotide
ugaauccgcuccccaaacu

SEQ ID NO: 12209 - RNA, 19 nt, Artificial Sequence
  Description of Artificial Sequence: Synthetic oligonucleotide
uggaauccgcuccccaaac

SEQ ID NO: 12210 - RNA, 19 nt, Artificial Sequence
  Description of Artificial Sequence: Synthetic oligonucleotide
ucggaauccgcuccccaaa

SEQ ID NO: 12211 - RNA, 19 nt, Artificial Sequence
  Description of Artificial Sequence: Synthetic oligonucleotide
uccggaauccgcuccccaa

SEQ ID NO: 12212 - RNA, 19 nt, Artificial Sequence
  Description of Artificial Sequence: Synthetic oligonucleotide
ugccggaauccgcucccca

SEQ ID NO: 12213 - RNA, 19 nt, Artificial Sequence
  Description of Artificial Sequence: Synthetic oligonucleotide
uggccggaauccgcucccc

SEQ ID NO: 12214 - RNA, 19 nt, Artificial Sequence
  Description of Artificial Sequence: Synthetic oligonucleotide
ucggccggaauccgcuccc

SEQ ID NO: 12215 - RNA, 19 nt, Artificial Sequence
  Description of Artificial Sequence: Synthetic oligonucleotide
uucggccggaauccgcucc

SEQ ID NO: 12216 - RNA, 19 nt, Artificial Sequence
  Description of Artificial Sequence: Synthetic oligonucleotide
ucucggccggaauccgcuc

SEQ ID NO: 12217 - RNA, 19 nt, Artificial Sequence
  Description of Artificial Sequence: Synthetic oligonucleotide
uucucggccggaauccgcu

SEQ ID NO: 12218 - RNA, 19 nt, Artificial Sequence
  Description of Artificial Sequence: Synthetic oligonucleotide
uaucucggccggaauccgc

SEQ ID NO: 12219 - RNA, 19 nt, Artificial Sequence
  Description of Artificial Sequence: Synthetic oligonucleotide
ucaucucggccggaauccg

SEQ ID NO: 12220 - RNA, 19 nt, Artificial Sequence
  Description of Artificial Sequence: Synthetic oligonucleotide
uccaucucggccggaaucc

SEQ ID NO: 12221 - RNA, 19 nt, Artificial Sequence
  Description of Artificial Sequence: Synthetic oligonucleotide
ugccaucucggccggaauc

SEQ ID NO: 12222 - RNA, 19 nt, Artificial Sequence
  Description of Artificial Sequence: Synthetic oligonucleotide
ucgccaucucggccggaau

SEQ ID NO: 12223 - RNA, 19 nt, Artificial Sequence
  Description of Artificial Sequence: Synthetic oligonucleotide
ugcgccaucucggccggaa

SEQ ID NO: 12224 - RNA, 19 nt, Artificial Sequence
  Description of Artificial Sequence: Synthetic oligonucleotide
ucgcgccaucucggccgga

SEQ ID NO: 12225 - RNA, 19 nt, Artificial Sequence
  Description of Artificial Sequence: Synthetic oligonucleotide
ugcgcgccaucucggccgg

SEQ ID NO: 12226 - RNA, 19 nt, Artificial Sequence
  Description of Artificial Sequence: Synthetic oligonucleotide
uagcgcgccaucucggccg

SEQ ID NO: 12227 - RNA, 19 nt, Artificial Sequence
  Description of Artificial Sequence: Synthetic oligonucleotide
uaagcgcgccaucucggcc

SEQ ID NO: 12228 - RNA, 19 nt, Artificial Sequence
  Description of Artificial Sequence: Synthetic oligonucleotide
ugaagcgcgccaucucggc

SEQ ID NO: 12229 - RNA, 19 nt, Artificial Sequence
  Description of Artificial Sequence: Synthetic oligonucleotide
uagaagcgcgccaucucgg

SEQ ID NO: 12230 - RNA, 19 nt, Artificial Sequence
  Description of Artificial Sequence: Synthetic oligonucleotide
uuagaagcgcgccaucucg

SEQ ID NO: 12231 - RNA, 19 nt, Artificial Sequence
  Description of Artificial Sequence: Synthetic oligonucleotide
uguagaagcgcgccaucuc

SEQ ID NO: 12232 - RNA, 19 nt, Artificial Sequence
  Description of Artificial Sequence: Synthetic oligonucleotide
ugguagaagcgcgccaucu

SEQ ID NO: 12233 - RNA, 19 nt, Artificial Sequence
  Description of Artificial Sequence: Synthetic oligonucleotide
uagguagaagcgcgccauc

SEQ ID NO: 12234 - RNA, 19 nt, Artificial Sequence
  Description of Artificial Sequence: Synthetic oligonucleotide
ucagguagaagcgcgccau

SEQ ID NO: 12235 - RNA, 19 nt, Artificial Sequence
  Description of Artificial Sequence: Synthetic oligonucleotide
uccagguagaagcgcgcca

SEQ ID NO: 12236 - RNA, 19 nt, Artificial Sequence
  Description of Artificial Sequence: Synthetic oligonucleotide
ugccagguagaagcgcgcc

SEQ ID NO: 12237 - RNA, 19 nt, Artificial Sequence
  Description of Artificial Sequence: Synthetic oligonucleotide
ucgccagguagaagcgcgc

SEQ ID NO: 12238 - RNA, 19 nt, Artificial Sequence
  Description of Artificial Sequence: Synthetic oligonucleotide
uccgccagguagaagcgcg

SEQ ID NO: 12239 - RNA, 19 nt, Artificial Sequence
  Description of Artificial Sequence: Synthetic oligonucleotide
uuccgccagguagaagcgc

SEQ ID NO: 12240 - RNA, 19 nt, Artificial Sequence
  Description of Artificial Sequence: Synthetic oligonucleotide
ucuccgccagguagaagcg

SEQ ID NO: 12241 - RNA, 19 nt, Artificial Sequence
  Description of Artificial Sequence: Synthetic oligonucleotide
uucuccgccagguagaagc

SEQ ID NO: 12242 - RNA, 19 nt, Artificial Sequence
  Description of Artificial Sequence: Synthetic oligonucleotide
uaucuccgccagguagaag

SEQ ID NO: 12243 - RNA, 19 nt, Artificial Sequence
  Description of Artificial Sequence: Synthetic oligonucleotide
uaaucuccgccagguagaa

SEQ ID NO: 12244 - RNA, 19 nt, Artificial Sequence
  Description of Artificial Sequence: Synthetic oligonucleotide
ucaaucuccgccagguaga

SEQ ID NO: 12245 - RNA, 19 nt, Artificial Sequence
  Description of Artificial Sequence: Synthetic oligonucleotide
uacaaucuccgccagguag

SEQ ID NO: 12246 - RNA, 19 nt, Artificial Sequence
  Description of Artificial Sequence: Synthetic oligonucleotide
ugacaaucuccgccaggua

SEQ ID NO: 12247 - RNA, 19 nt, Artificial Sequence
  Description of Artificial Sequence: Synthetic oligonucleotide
uugacaaucuccgccaggu

SEQ ID NO: 12248 - RNA, 19 nt, Artificial Sequence
  Description of Artificial Sequence: Synthetic oligonucleotide
uaugacaaucuccgccagg

SEQ ID NO: 12249 - RNA, 19 nt, Artificial Sequence
  Description of Artificial Sequence: Synthetic oligonucleotide
ucaugacaaucuccgccag

SEQ ID NO: 12250 - RNA, 19 nt, Artificial Sequence
  Description of Artificial Sequence: Synthetic oligonucleotide
uccaugacaaucuccgcca

SEQ ID NO: 12251 - RNA, 19 nt, Artificial Sequence
  Description of Artificial Sequence: Synthetic oligonucleotide
ugccaugacaaucuccgcc

SEQ ID NO: 12252 - RNA, 19 nt, Artificial Sequence
  Description of Artificial Sequence: Synthetic oligonucleotide
uggccaugacaaucuccgc

SEQ ID NO: 12253 - RNA, 19 nt, Artificial Sequence
  Description of Artificial Sequence: Synthetic oligonucleotide
uuggccaugacaaucuccg

SEQ ID NO: 12254 - RNA, 19 nt, Artificial Sequence
  Description of Artificial Sequence: Synthetic oligonucleotide
uauggccaugacaaucucc

SEQ ID NO: 12255 - RNA, 19 nt, Artificial Sequence
  Description of Artificial Sequence: Synthetic oligonucleotide
uuauggccaugacaaucuc

SEQ ID NO: 12256 - RNA, 19 nt, Artificial Sequence
  Description of Artificial Sequence: Synthetic oligonucleotide
ucuauggccaugacaaucu

SEQ ID NO: 12257 - RNA, 19 nt, Artificial Sequence
  Description of Artificial Sequence: Synthetic oligonucleotide
uucuauggccaugacaauc

SEQ ID NO: 12258 - RNA, 19 nt, Artificial Sequence
  Description of Artificial Sequence: Synthetic oligonucleotide
ugucuauggccaugacaau

SEQ ID NO: 12259 - RNA, 19 nt, Artificial Sequence
  Description of Artificial Sequence: Synthetic oligonucleotide
uagucuauggccaugacaa

SEQ ID NO: 12260 - RNA, 19 nt, Artificial Sequence
  Description of Artificial Sequence: Synthetic oligonucleotide
ugagucuauggccaugaca

SEQ ID NO: 12261 - RNA, 19 nt, Artificial Sequence
  Description of Artificial Sequence: Synthetic oligonucleotide
ucgagucuauggccaugac

SEQ ID NO: 12262 - RNA, 19 nt, Artificial Sequence
  Description of Artificial Sequence: Synthetic oligonucleotide
uccgagucuauggccauga

SEQ ID NO: 12263 - RNA, 19 nt, Artificial Sequence
  Description of Artificial Sequence: Synthetic oligonucleotide
uaccgagucuauggccaug

SEQ ID NO: 12264 - RNA, 19 nt, Artificial Sequence
  Description of Artificial Sequence: Synthetic oligonucleotide
ucaccgagucuauggccau

SEQ ID NO: 12265 - RNA, 19 nt, Artificial Sequence
  Description of Artificial Sequence: Synthetic oligonucleotide
ugcaccgagucuauggcca

SEQ ID NO: 12266 - RNA, 19 nt, Artificial Sequence
  Description of Artificial Sequence: Synthetic oligonucleotide
uugcaccgagucuauggcc

SEQ ID NO: 12267 - RNA, 19 nt, Artificial Sequence
  Description of Artificial Sequence: Synthetic oligonucleotide
ugugcaccgagucuauggc

SEQ ID NO: 12268 - RNA, 19 nt, Artificial Sequence
  Description of Artificial Sequence: Synthetic oligonucleotide
uggugcaccgagucuaugg

SEQ ID NO: 12269 - RNA, 19 nt, Artificial Sequence
  Description of Artificial Sequence: Synthetic oligonucleotide
ucggugcaccgagucuaug

SEQ ID NO: 12270 - RNA, 19 nt, Artificial Sequence
  Description of Artificial Sequence: Synthetic oligonucleotide
uccggugcaccgagucuau

SEQ ID NO: 12271 - RNA, 19 nt, Artificial Sequence
  Description of Artificial Sequence: Synthetic oligonucleotide
ugccggugcaccgagucua

SEQ ID NO: 12272 - RNA, 19 nt, Artificial Sequence
  Description of Artificial Sequence: Synthetic oligonucleotide
uagccggugcaccgagucu

SEQ ID NO: 12273 - RNA, 19 nt, Artificial Sequence
  Description of Artificial Sequence: Synthetic oligonucleotide
uaagccggugcaccgaguc

SEQ ID NO: 12274 - RNA, 19 nt, Artificial Sequence
  Description of Artificial Sequence: Synthetic oligonucleotide
ucaagccggugcaccgagu

SEQ ID NO: 12275 - RNA, 19 nt, Artificial Sequence
  Description of Artificial Sequence: Synthetic oligonucleotide
uccaagccggugcaccgag

SEQ ID NO: 12276 - RNA, 19 nt, Artificial Sequence
  Description of Artificial Sequence: Synthetic oligonucleotide
ugccaagccggugcaccga

SEQ ID NO: 12277 - RNA, 19 nt, Artificial Sequence
  Description of Artificial Sequence: Synthetic oligonucleotide
uagccaagccggugcaccg

SEQ ID NO: 12278 - RNA, 19 nt, Artificial Sequence
  Description of Artificial Sequence: Synthetic oligonucleotide
uuagccaagccggugcacc

SEQ ID NO: 12279 - RNA, 19 nt, Artificial Sequence
  Description of Artificial Sequence: Synthetic oligonucleotide
uguagccaagccggugcac

SEQ ID NO: 12280 - RNA, 19 nt, Artificial Sequence
  Description of Artificial Sequence: Synthetic oligonucleotide
ucguagccaagccggugca

SEQ ID NO: 12281 - RNA, 19 nt, Artificial Sequence
  Description of Artificial Sequence: Synthetic oligonucleotide
uacguagccaagccggugc

SEQ ID NO: 12282 - RNA, 19 nt, Artificial Sequence
  Description of Artificial Sequence: Synthetic oligonucleotide
ucacguagccaagccggug

SEQ ID NO: 12283 - RNA, 19 nt, Artificial Sequence
  Description of Artificial Sequence: Synthetic oligonucleotide
ugcacguagccaagccggu

SEQ ID NO: 12284 - RNA, 19 nt, Artificial Sequence
  Description of Artificial Sequence: Synthetic oligonucleotide
uugcacguagccaagccgg

SEQ ID NO: 12285 - RNA, 19 nt, Artificial Sequence
  Description of Artificial Sequence: Synthetic oligonucleotide
ugugcacguagccaagccg

SEQ ID NO: 12286 - RNA, 19 nt, Artificial Sequence
  Description of Artificial Sequence: Synthetic oligonucleotide
uugugcacguagccaagcc

SEQ ID NO: 12287 - RNA, 19 nt, Artificial Sequence
  Description of Artificial Sequence: Synthetic oligonucleotide
ucugugcacguagccaagc

SEQ ID NO: 12288 - RNA, 19 nt, Artificial Sequence
  Description of Artificial Sequence: Synthetic oligonucleotide
uccugugcacguagccaag

SEQ ID NO: 12289 - RNA, 19 nt, Artificial Sequence
  Description of Artificial Sequence: Synthetic oligonucleotide
ucccugugcacguagccaa

SEQ ID NO: 12290 - RNA, 19 nt, Artificial Sequence
  Description of Artificial Sequence: Synthetic oligonucleotide
uucccugugcacguagcca

SEQ ID NO: 12291 - RNA, 19 nt, Artificial Sequence
  Description of Artificial Sequence: Synthetic oligonucleotide
ugucccugugcacguagcc

SEQ ID NO: 12292 - RNA, 19 nt, Artificial Sequence
  Description of Artificial Sequence: Synthetic oligonucleotide
uugucccugugcacguagc

SEQ ID NO: 12293 - RNA, 19 nt, Artificial Sequence
  Description of Artificial Sequence: Synthetic oligonucleotide
uaugucccugugcacguag

SEQ ID NO: 12294 - RNA, 19 nt, Artificial Sequence
  Description of Artificial Sequence: Synthetic oligonucleotide
ugaugucccugugcacgua

SEQ ID NO: 12295 - RNA, 19 nt, Artificial Sequence
  Description of Artificial Sequence: Synthetic oligonucleotide
uugaugucccugugcacgu

SEQ ID NO: 12296 - RNA, 19 nt, Artificial Sequence
  Description of Artificial Sequence: Synthetic oligonucleotide
uuugaugucccugugcacg

SEQ ID NO: 12297 - RNA, 19 nt, Artificial Sequence
  Description of Artificial Sequence: Synthetic oligonucleotide
uuuugaugucccugugcac

SEQ ID NO: 12298 - RNA, 19 nt, Artificial Sequence
  Description of Artificial Sequence: Synthetic oligonucleotide
uguuugaugucccugugca

SEQ ID NO: 12299 - RNA, 19 nt, Artificial Sequence
  Description of Artificial Sequence: Synthetic oligonucleotide
ugguuugaugucccugugc

SEQ ID NO: 12300 - RNA, 19 nt, Artificial Sequence
  Description of Artificial Sequence: Synthetic oligonucleotide
uggguuugaugucccugug

SEQ ID NO: 12301 - RNA, 19 nt, Artificial Sequence
  Description of Artificial Sequence: Synthetic oligonucleotide
ucggguuugaugucccugu

SEQ ID NO: 12302 - RNA, 19 nt, Artificial Sequence
  Description of Artificial Sequence: Synthetic oligonucleotide
uucggguuugaugucccug

SEQ ID NO: 12303 - RNA, 19 nt, Artificial Sequence
  Description of Artificial Sequence: Synthetic oligonucleotide
ugucggguuugaugucccu

SEQ ID NO: 12304 - RNA, 19 nt, Artificial Sequence
  Description of Artificial Sequence: Synthetic oligonucleotide
uugucggguuugauguccc

SEQ ID NO: 12305 - RNA, 19 nt, Artificial Sequence
  Description of Artificial Sequence: Synthetic oligonucleotide
uuugucggguuugaugucc

SEQ ID NO: 12306 - RNA, 19 nt, Artificial Sequence
  Description of Artificial Sequence: Synthetic oligonucleotide
uguugucggguuugauguc

SEQ ID NO: 12307 - RNA, 19 nt, Artificial Sequence
  Description of Artificial Sequence: Synthetic oligonucleotide
uuguugucggguuugaugu

SEQ ID NO: 12308 - RNA, 19 nt, Artificial Sequence
  Description of Artificial Sequence: Synthetic oligonucleotide
uauguugucggguuugaug

SEQ ID NO: 12309 - RNA, 19 nt, Artificial Sequence
  Description of Artificial Sequence: Synthetic oligonucleotide
ugauguugucggguuugau

SEQ ID NO: 12310 - RNA, 19 nt, Artificial Sequence
  Description of Artificial Sequence: Synthetic oligonucleotide
uggauguugucggguuuga

SEQ ID NO: 12311 - RNA, 19 nt, Artificial Sequence
  Description of Artificial Sequence: Synthetic oligonucleotide
uaggauguugucggguuug

SEQ ID NO: 12312 - RNA, 19 nt, Artificial Sequence
  Description of Artificial Sequence: Synthetic oligonucleotide
ucaggauguugucggguuu

SEQ ID NO: 12313 - RNA, 19 nt, Artificial Sequence
  Description of Artificial Sequence: Synthetic oligonucleotide
ugcaggauguugucggguu

SEQ ID NO: 12314 - RNA, 19 nt, Artificial Sequence
  Description of Artificial Sequence: Synthetic oligonucleotide
uagcaggauguugucgggu

SEQ ID NO: 12315 - RNA, 19 nt, Artificial Sequence
  Description of Artificial Sequence: Synthetic oligonucleotide
ucagcaggauguugucggg

SEQ ID NO: 12316 - RNA, 19 nt, Artificial Sequence
  Description of Artificial Sequence: Synthetic oligonucleotide
uccagcaggauguugucgg

SEQ ID NO: 12317 - RNA, 19 nt, Artificial Sequence
  Description of Artificial Sequence: Synthetic oligonucleotide
uuccagcaggauguugucg

SEQ ID NO: 12318 - RNA, 19 nt, Artificial Sequence
  Description of Artificial Sequence: Synthetic oligonucleotide
uguccagcaggauguuguc

SEQ ID NO: 12319 - RNA, 19 nt, Artificial Sequence
  Description of Artificial Sequence: Synthetic oligonucleotide
ugguccagcaggauguugu

SEQ ID NO: 12320 - RNA, 19 nt, Artificial Sequence
  Description of Artificial Sequence: Synthetic oligonucleotide
ucgguccagcaggauguug

SEQ ID NO: 12321 - RNA, 19 nt, Artificial Sequence
  Description of Artificial Sequence: Synthetic oligonucleotide
ugcgguccagcaggauguu

SEQ ID NO: 12322 - RNA, 19 nt, Artificial Sequence
  Description of Artificial Sequence: Synthetic oligonucleotide
uagcgguccagcaggaugu

SEQ ID NO: 12323 - RNA, 19 nt, Artificial Sequence
  Description of Artificial Sequence: Synthetic oligonucleotide
ucagcgguccagcaggaug

SEQ ID NO: 12324 - RNA, 19 nt, Artificial Sequence
  Description of Artificial Sequence: Synthetic oligonucleotide
uacagcgguccagcaggau

SEQ ID NO: 12325 - RNA, 19 nt, Artificial Sequence
  Description of Artificial Sequence: Synthetic oligonucleotide
ucacagcgguccagcagga

SEQ ID NO: 12326 - RNA, 19 nt, Artificial Sequence
  Description of Artificial Sequence: Synthetic oligonucleotide
uccacagcgguccagcagg

SEQ ID NO: 12327 - RNA, 19 nt, Artificial Sequence
  Description of Artificial Sequence: Synthetic oligonucleotide
ugccacagcgguccagcag

SEQ ID NO: 12328 - RNA, 19 nt, Artificial Sequence
  Description of Artificial Sequence: Synthetic oligonucleotide
uggccacagcgguccagca

SEQ ID NO: 12329 - RNA, 19 nt, Artificial Sequence
  Description of Artificial Sequence: Synthetic oligonucleotide
uuggccacagcgguccagc

SEQ ID NO: 12330 - RNA, 19 nt, Artificial Sequence
  Description of Artificial Sequence: Synthetic oligonucleotide
uguggccacagcgguccag

SEQ ID NO: 12331 - RNA, 19 nt, Artificial Sequence
  Description of Artificial Sequence: Synthetic oligonucleotide
uuguggccacagcggucca

SEQ ID NO: 12332 - RNA, 19 nt, Artificial Sequence
  Description of Artificial Sequence: Synthetic oligonucleotide
uauguggccacagcggucc

SEQ ID NO: 12333 - RNA, 19 nt, Artificial Sequence
  Description of Artificial Sequence: Synthetic oligonucleotide
ugauguggccacagcgguc

SEQ ID NO: 12334 - RNA, 19 nt, Artificial Sequence
  Description of Artificial Sequence: Synthetic oligonucleotide
uggauguggccacagcggu

SEQ ID NO: 12335 - RNA, 19 nt, Artificial Sequence
  Description of Artificial Sequence: Synthetic oligonucleotide
ucggauguggccacagcgg

SEQ ID NO: 12336 - RNA, 19 nt, Artificial Sequence
  Description of Artificial Sequence: Synthetic oligonucleotide
ugcggauguggccacagcg

SEQ ID NO: 12337 - RNA, 19 nt, Artificial Sequence
  Description of Artificial Sequence: Synthetic oligonucleotide
uggcggauguggccacagc

SEQ ID NO: 12338 - RNA, 19 nt, Artificial Sequence
  Description of Artificial Sequence: Synthetic oligonucleotide
uaggcggauguggccacag

SEQ ID NO: 12339 - RNA, 19 nt, Artificial Sequence
  Description of Artificial Sequence: Synthetic oligonucleotide
ucaggcggauguggccaca

SEQ ID NO: 12340 - RNA, 19 nt, Artificial Sequence
  Description of Artificial Sequence: Synthetic oligonucleotide
uccaggcggauguggccac

SEQ ID NO: 12341 - RNA, 19 nt, Artificial Sequence
  Description of Artificial Sequence: Synthetic oligonucleotide
ugccaggcggauguggcca

SEQ ID NO: 12342 - RNA, 19 nt, Artificial Sequence
  Description of Artificial Sequence: Synthetic oligonucleotide
uggccaggcggauguggcc

SEQ ID NO: 12343 - RNA, 19 nt, Artificial Sequence
  Description of Artificial Sequence: Synthetic oligonucleotide
ucggccaggcggauguggc

SEQ ID NO: 12344 - RNA, 19 nt, Artificial Sequence
  Description of Artificial Sequence: Synthetic oligonucleotide
uucggccaggcggaugugg

SEQ ID NO: 12345 - RNA, 19 nt, Artificial Sequence
  Description of Artificial Sequence: Synthetic oligonucleotide
ugucggccaggcggaugug

SEQ ID NO: 12346 - RNA, 19 nt, Artificial Sequence
  Description of Artificial Sequence: Synthetic oligonucleotide
uagucggccaggcggaugu

SEQ ID NO: 12347 - RNA, 19 nt, Artificial Sequence
  Description of Artificial Sequence: Synthetic oligonucleotide
uaagucggccaggcggaug

SEQ ID NO: 12348 - RNA, 19 nt, Artificial Sequence
  Description of Artificial Sequence: Synthetic oligonucleotide
ugaagucggccaggcggau

SEQ ID NO: 12349 - RNA, 19 nt, Artificial Sequence
  Description of Artificial Sequence: Synthetic oligonucleotide
ucgaagucggccaggcgga

SEQ ID NO: 12350 - RNA, 19 nt, Artificial Sequence
  Description of Artificial Sequence: Synthetic oligonucleotide
uccgaagucggccaggcgg

SEQ ID NO: 12351 - RNA, 19 nt, Artificial Sequence
  Description of Artificial Sequence: Synthetic oligonucleotide
ugccgaagucggccaggcg

SEQ ID NO: 12352 - RNA, 19 nt, Artificial Sequence
  Description of Artificial Sequence: Synthetic oligonucleotide
uagccgaagucggccaggc

SEQ ID NO: 12353 - RNA, 19 nt, Artificial Sequence
  Description of Artificial Sequence: Synthetic oligonucleotide
ugagccgaagucggccagg

SEQ ID NO: 12354 - RNA, 19 nt, Artificial Sequence
  Description of Artificial Sequence: Synthetic oligonucleotide
uagagccgaagucggccag

SEQ ID NO: 12355 - RNA, 19 nt, Artificial Sequence
  Description of Artificial Sequence: Synthetic oligonucleotide
uaagagccgaagucggcca

SEQ ID NO: 12356 - RNA, 19 nt, Artificial Sequence
  Description of Artificial Sequence: Synthetic oligonucleotide
ucaagagccgaagucggcc

SEQ ID NO: 12357 - RNA, 19 nt, Artificial Sequence
  Description of Artificial Sequence: Synthetic oligonucleotide
ugcaagagccgaagucggc

SEQ ID NO: 12358 - RNA, 19 nt, Artificial Sequence
  Description of Artificial Sequence: Synthetic oligonucleotide
uggcaagagccgaagucgg

SEQ ID NO: 12359 - RNA, 19 nt, Artificial Sequence
  Description of Artificial Sequence: Synthetic oligonucleotide
uaggcaagagccgaagucg

SEQ ID NO: 12360 - RNA, 19 nt, Artificial Sequence
  Description of Artificial Sequence: Synthetic oligonucleotide
ugaggcaagagccgaaguc

SEQ ID NO: 12361 - RNA, 19 nt, Artificial Sequence
  Description of Artificial Sequence: Synthetic oligonucleotide
uugaggcaagagccgaagu

SEQ ID NO: 12362 - RNA, 19 nt, Artificial Sequence
  Description of Artificial Sequence: Synthetic oligonucleotide
uuugaggcaagagccgaag

SEQ ID NO: 12363 - RNA, 19 nt, Artificial Sequence
  Description of Artificial Sequence: Synthetic oligonucleotide
ucuugaggcaagagccgaa

SEQ ID NO: 12364 - RNA, 19 nt, Artificial Sequence
  Description of Artificial Sequence: Synthetic oligonucleotide
ugcuugaggcaagagccga

SEQ ID NO: 12365 - RNA, 19 nt, Artificial Sequence
  Description of Artificial Sequence: Synthetic oligonucleotide
uagcuugaggcaagagccg

SEQ ID NO: 12366 - RNA, 19 nt, Artificial Sequence
  Description of Artificial Sequence: Synthetic oligonucleotide
ucagcuugaggcaagagcc

SEQ ID NO: 12367 - RNA, 19 nt, Artificial Sequence
  Description of Artificial Sequence: Synthetic oligonucleotide
ugcagcuugaggcaagagc

SEQ ID NO: 12368 - RNA, 19 nt, Artificial Sequence
  Description of Artificial Sequence: Synthetic oligonucleotide
ucgcagcuugaggcaagag

SEQ ID NO: 12369 - RNA, 19 nt, Artificial Sequence
  Description of Artificial Sequence: Synthetic oligonucleotide
uccgcagcuugaggcaaga

SEQ ID NO: 12370 - RNA, 19 nt, Artificial Sequence
  Description of Artificial Sequence: Synthetic oligonucleotide
ucccgcagcuugaggcaag

SEQ ID NO: 12371 - RNA, 19 nt, Artificial Sequence
  Description of Artificial Sequence: Synthetic oligonucleotide
ugcccgcagcuugaggcaa

SEQ ID NO: 12372 - RNA, 19 nt, Artificial Sequence
  Description of Artificial Sequence: Synthetic oligonucleotide
uugcccgcagcuugaggca

SEQ ID NO: 12373 - RNA, 19 nt, Artificial Sequence
  Description of Artificial Sequence: Synthetic oligonucleotide
ucugcccgcagcuugaggc

SEQ ID NO: 12374 - RNA, 19 nt, Artificial Sequence
  Description of Artificial Sequence: Synthetic oligonucleotide
uucugcccgcagcuugagg

SEQ ID NO: 12375 - RNA, 19 nt, Artificial Sequence
  Description of Artificial Sequence: Synthetic oligonucleotide
uaucugcccgcagcuugag

SEQ ID NO: 12376 - RNA, 19 nt, Artificial Sequence
  Description of Artificial Sequence: Synthetic oligonucleotide
ucaucugcccgcagcuuga

SEQ ID NO: 12377 - RNA, 19 nt, Artificial Sequence
  Description of Artificial Sequence: Synthetic oligonucleotide
uccaucugcccgcagcuug

SEQ ID NO: 12378 - RNA, 19 nt, Artificial Sequence
  Description of Artificial Sequence: Synthetic oligonucleotide
uuccaucugcccgcagcuu

SEQ ID NO: 12379 - RNA, 19 nt, Artificial Sequence
  Description of Artificial Sequence: Synthetic oligonucleotide
uuuccaucugcccgcagcu

SEQ ID NO: 12380 - RNA, 19 nt, Artificial Sequence
  Description of Artificial Sequence: Synthetic oligonucleotide
uguuccaucugcccgcagc

SEQ ID NO: 12381 - RNA, 19 nt, Artificial Sequence
  Description of Artificial Sequence: Synthetic oligonucleotide
ucguuccaucugcccgcag

SEQ ID NO: 12382 - RNA, 19 nt, Artificial Sequence
  Description of Artificial Sequence: Synthetic oligonucleotide
uccguuccaucugcccgca

SEQ ID NO: 12383 - RNA, 19 nt, Artificial Sequence
  Description of Artificial Sequence: Synthetic oligonucleotide
uaccguuccaucugcccgc

SEQ ID NO: 12384 - RNA, 19 nt, Artificial Sequence
  Description of Artificial Sequence: Synthetic oligonucleotide
ucaccguuccaucugcccg

SEQ ID NO: 12385 - RNA, 19 nt, Artificial Sequence
  Description of Artificial Sequence: Synthetic oligonucleotide
ugcaccguuccaucugccc

SEQ ID NO: 12386 - RNA, 19 nt, Artificial Sequence
  Description of Artificial Sequence: Synthetic oligonucleotide
ucgcaccguuccaucugcc

SEQ ID NO: 12387 - RNA, 19 nt, Artificial Sequence
  Description of Artificial Sequence: Synthetic oligonucleotide
uccgcaccguuccaucugc

SEQ ID NO: 12388 - RNA, 19 nt, Artificial Sequence
  Description of Artificial Sequence: Synthetic oligonucleotide
uaccgcaccguuccaucug

SEQ ID NO: 12389 - RNA, 19 nt, Artificial Sequence
  Description of Artificial Sequence: Synthetic oligonucleotide
ugaccgcaccguuccaucu

SEQ ID NO: 12390 - RNA, 19 nt, Artificial Sequence
  Description of Artificial Sequence: Synthetic oligonucleotide
ucgaccgcaccguuccauc

SEQ ID NO: 12391 - RNA, 19 nt, Artificial Sequence
  Description of Artificial Sequence: Synthetic oligonucleotide
ugcgaccgcaccguuccau

SEQ ID NO: 12392 - RNA, 19 nt, Artificial Sequence
  Description of Artificial Sequence: Synthetic oligonucleotide
uagcgaccgcaccguucca

SEQ ID NO: 12393 - RNA, 19 nt, Artificial Sequence
  Description of Artificial Sequence: Synthetic oligonucleotide
ucagcgaccgcaccguucc

SEQ ID NO: 12394 - RNA, 19 nt, Artificial Sequence
  Description of Artificial Sequence: Synthetic oligonucleotide
uccagcgaccgcaccguuc

SEQ ID NO: 12395 - RNA, 19 nt, Artificial Sequence
  Description of Artificial Sequence: Synthetic oligonucleotide
uaccagcgaccgcaccguu

SEQ ID NO: 12396 - RNA, 19 nt, Artificial Sequence
  Description of Artificial Sequence: Synthetic oligonucleotide
ucaccagcgaccgcaccgu

SEQ ID NO: 12397 - RNA, 19 nt, Artificial Sequence
  Description of Artificial Sequence: Synthetic oligonucleotide
uccaccagcgaccgcaccg

SEQ ID NO: 12398 - RNA, 19 nt, Artificial Sequence
  Description of Artificial Sequence: Synthetic oligonucleotide
ugccaccagcgaccgcacc

SEQ ID NO: 12399 - RNA, 19 nt, Artificial Sequence
  Description of Artificial Sequence: Synthetic oligonucleotide
uagccaccagcgaccgcac

SEQ ID NO: 12400 - RNA, 19 nt, Artificial Sequence
  Description of Artificial Sequence: Synthetic oligonucleotide
ucagccaccagcgaccgca

SEQ ID NO: 12401 - RNA, 19 nt, Artificial Sequence
  Description of Artificial Sequence: Synthetic oligonucleotide
uacagccaccagcgaccgc

SEQ ID NO: 12402 - RNA, 19 nt, Artificial Sequence
  Description of Artificial Sequence: Synthetic oligonucleotide
ucacagccaccagcgaccg

SEQ ID NO: 12403 - RNA, 19 nt, Artificial Sequence
  Description of Artificial Sequence: Synthetic oligonucleotide
uccacagccaccagcgacc

SEQ ID NO: 12404 - RNA, 19 nt, Artificial Sequence
  Description of Artificial Sequence: Synthetic oligonucleotide
ucccacagccaccagcgac

SEQ ID NO: 12405 - RNA, 19 nt, Artificial Sequence
  Description of Artificial Sequence: Synthetic oligonucleotide
ugcccacagccaccagcga

SEQ ID NO: 12406 - RNA, 19 nt, Artificial Sequence
  Description of Artificial Sequence: Synthetic oligonucleotide
uugcccacagccaccagcg

SEQ ID NO: 12407 - RNA, 19 nt, Artificial Sequence
  Description of Artificial Sequence: Synthetic oligonucleotide
ugugcccacagccaccagc

SEQ ID NO: 12408 - RNA, 19 nt, Artificial Sequence
  Description of Artificial Sequence: Synthetic oligonucleotide
uggugcccacagccaccag

SEQ ID NO: 12409 - RNA, 19 nt, Artificial Sequence
  Description of Artificial Sequence: Synthetic oligonucleotide
ugggugcccacagccacca

SEQ ID NO: 12410 - RNA, 19 nt, Artificial Sequence
  Description of Artificial Sequence: Synthetic oligonucleotide
uggggugcccacagccacc

SEQ ID NO: 12411 - RNA, 19 nt, Artificial Sequence
  Description of Artificial Sequence: Synthetic oligonucleotide
uuggggugcccacagccac

SEQ ID NO: 12412 - RNA, 19 nt, Artificial Sequence
  Description of Artificial Sequence: Synthetic oligonucleotide
ucuggggugcccacagcca

SEQ ID NO: 12413 - RNA, 19 nt, Artificial Sequence
  Description of Artificial Sequence: Synthetic oligonucleotide
uucuggggugcccacagcc

SEQ ID NO: 12414 - RNA, 19 nt, Artificial Sequence
  Description of Artificial Sequence: Synthetic oligonucleotide
ugucuggggugcccacagc

SEQ ID NO: 12415 - RNA, 19 nt, Artificial Sequence
  Description of Artificial Sequence: Synthetic oligonucleotide
uagucuggggugcccacag

SEQ ID NO: 12416 - RNA, 19 nt, Artificial Sequence
  Description of Artificial Sequence: Synthetic oligonucleotide
uuagucuggggugcccaca

SEQ ID NO: 12417 - RNA, 19 nt, Artificial Sequence
  Description of Artificial Sequence: Synthetic oligonucleotide
uguagucuggggugcccac

SEQ ID NO: 12418 - RNA, 19 nt, Artificial Sequence
  Description of Artificial Sequence: Synthetic oligonucleotide
ugguagucuggggugccca

SEQ ID NO: 12419 - RNA, 19 nt, Artificial Sequence
  Description of Artificial Sequence: Synthetic oligonucleotide
uagguagucuggggugccc

SEQ ID NO: 12420 - RNA, 19 nt, Artificial Sequence
  Description of Artificial Sequence: Synthetic oligonucleotide
ucagguagucuggggugcc

SEQ ID NO: 12421 - RNA, 19 nt, Artificial Sequence
  Description of Artificial Sequence: Synthetic oligonucleotide
uacagguagucuggggugc

SEQ ID NO: 12422 - RNA, 19 nt, Artificial Sequence
  Description of Artificial Sequence: Synthetic oligonucleotide
ugacagguagucuggggug

SEQ ID NO: 12423 - RNA, 19 nt, Artificial Sequence
  Description of Artificial Sequence: Synthetic oligonucleotide
uggacagguagucuggggu

SEQ ID NO: 12424 - RNA, 19 nt, Artificial Sequence
  Description of Artificial Sequence: Synthetic oligonucleotide
ugggacagguagucugggg

SEQ ID NO: 12425 - RNA, 19 nt, Artificial Sequence
  Description of Artificial Sequence: Synthetic oligonucleotide
uggggacagguagucuggg

SEQ ID NO: 12426 - RNA, 19 nt, Artificial Sequence
  Description of Artificial Sequence: Synthetic oligonucleotide
ugggggacagguagucugg

SEQ ID NO: 12427 - RNA, 19 nt, Artificial Sequence
  Description of Artificial Sequence: Synthetic oligonucleotide
ucgggggacagguagucug

SEQ ID NO: 12428 - RNA, 19 nt, Artificial Sequence
  Description of Artificial Sequence: Synthetic oligonucleotide
uucgggggacagguagucu

SEQ ID NO: 12429 - RNA, 19 nt, Artificial Sequence
  Description of Artificial Sequence: Synthetic oligonucleotide
ucucgggggacagguaguc

SEQ ID NO: 12430 - RNA, 19 nt, Artificial Sequence
  Description of Artificial Sequence: Synthetic oligonucleotide
uucucgggggacagguagu

SEQ ID NO: 12431 - RNA, 19 nt, Artificial Sequence
  Description of Artificial Sequence: Synthetic oligonucleotide
uaucucgggggacagguag

SEQ ID NO: 12432 - RNA, 19 nt, Artificial Sequence
  Description of Artificial Sequence: Synthetic oligonucleotide
ugaucucgggggacaggua

SEQ ID NO: 12433 - RNA, 19 nt, Artificial Sequence
  Description of Artificial Sequence: Synthetic oligonucleotide
uggaucucgggggacaggu

SEQ ID NO: 12434 - RNA, 19 nt, Artificial Sequence
  Description of Artificial Sequence: Synthetic oligonucleotide
uaggaucucgggggacagg

SEQ ID NO: 12435 - RNA, 19 nt, Artificial Sequence
  Description of Artificial Sequence: Synthetic oligonucleotide
ucaggaucucgggggacag

SEQ ID NO: 12436 - RNA, 19 nt, Artificial Sequence
  Description of Artificial Sequence: Synthetic oligonucleotide
ugcaggaucucgggggaca

SEQ ID NO: 12437 - RNA, 19 nt, Artificial Sequence
  Description of Artificial Sequence: Synthetic oligonucleotide
uugcaggaucucgggggac

SEQ ID NO: 12438 - RNA, 19 nt, Artificial Sequence
  Description of Artificial Sequence: Synthetic oligonucleotide
ucugcaggaucucggggga

SEQ ID NO: 12439 - RNA, 19 nt, Artificial Sequence
  Description of Artificial Sequence: Synthetic oligonucleotide
uccugcaggaucucggggg

SEQ ID NO: 12440 - RNA, 19 nt, Artificial Sequence
  Description of Artificial Sequence: Synthetic oligonucleotide
ugccugcaggaucucgggg

SEQ ID NO: 12441 - RNA, 19 nt, Artificial Sequence
  Description of Artificial Sequence: Synthetic oligonucleotide
uagccugcaggaucucggg

SEQ ID NO: 12442 - RNA, 19 nt, Artificial Sequence
  Description of Artificial Sequence: Synthetic oligonucleotide
ucagccugcaggaucucgg

SEQ ID NO: 12443 - RNA, 19 nt, Artificial Sequence
  Description of Artificial Sequence: Synthetic oligonucleotide
uacagccugcaggaucucg

SEQ ID NO: 12444 - RNA, 19 nt, Artificial Sequence
  Description of Artificial Sequence: Synthetic oligonucleotide
ucacagccugcaggaucuc

SEQ ID NO: 12445 - RNA, 19 nt, Artificial Sequence
  Description of Artificial Sequence: Synthetic oligonucleotide
uccacagccugcaggaucu

SEQ ID NO: 12446 - RNA, 19 nt, Artificial Sequence
  Description of Artificial Sequence: Synthetic oligonucleotide
ucccacagccugcaggauc

SEQ ID NO: 12447 - RNA, 19 nt, Artificial Sequence
  Description of Artificial Sequence: Synthetic oligonucleotide
ugcccacagccugcaggau

SEQ ID NO: 12448 - RNA, 19 nt, Artificial Sequence
  Description of Artificial Sequence: Synthetic oligonucleotide
ucgcccacagccugcagga

SEQ ID NO: 12449 - RNA, 19 nt, Artificial Sequence
  Description of Artificial Sequence: Synthetic oligonucleotide
uccgcccacagccugcagg

SEQ ID NO: 12450 - RNA, 19 nt, Artificial Sequence
  Description of Artificial Sequence: Synthetic oligonucleotide
uaccgcccacagccugcag

SEQ ID NO: 12451 - RNA, 19 nt, Artificial Sequence
  Description of Artificial Sequence: Synthetic oligonucleotide
ucaccgcccacagccugca

SEQ ID NO: 12452 - RNA, 19 nt, Artificial Sequence
  Description of Artificial Sequence: Synthetic oligonucleotide
uccaccgcccacagccugc

SEQ ID NO: 12453 - RNA, 19 nt, Artificial Sequence
  Description of Artificial Sequence: Synthetic oligonucleotide
ucccaccgcccacagccug

SEQ ID NO: 12454 - RNA, 19 nt, Artificial Sequence
  Description of Artificial Sequence: Synthetic oligonucleotide
ugcccaccgcccacagccu

SEQ ID NO: 12455 - RNA, 19 nt, Artificial Sequence
  Description of Artificial Sequence: Synthetic oligonucleotide
uggcccaccgcccacagcc

SEQ ID NO: 12456 - RNA, 19 nt, Artificial Sequence
  Description of Artificial Sequence: Synthetic oligonucleotide
uaggcccaccgcccacagc

SEQ ID NO: 12457 - RNA, 19 nt, Artificial Sequence
  Description of Artificial Sequence: Synthetic oligonucleotide
ucaggcccaccgcccacag

SEQ ID NO: 12458 - RNA, 19 nt, Artificial Sequence
  Description of Artificial Sequence: Synthetic oligonucleotide
uccaggcccaccgcccaca

SEQ ID NO: 12459 - RNA, 19 nt, Artificial Sequence
  Description of Artificial Sequence: Synthetic oligonucleotide
ucccaggcccaccgcccac

SEQ ID NO: 12460 - RNA, 19 nt, Artificial Sequence
  Description of Artificial Sequence: Synthetic oligonucleotide
uucccaggcccaccgccca

SEQ ID NO: 12461 - RNA, 19 nt, Artificial Sequence
  Description of Artificial Sequence: Synthetic oligonucleotide
ugucccaggcccaccgccc

SEQ ID NO: 12462 - RNA, 19 nt, Artificial Sequence
  Description of Artificial Sequence: Synthetic oligonucleotide
uugucccaggcccaccgcc

SEQ ID NO: 12463 - RNA, 19 nt, Artificial Sequence
  Description of Artificial Sequence: Synthetic oligonucleotide
ucugucccaggcccaccgc

SEQ ID NO: 12464 - RNA, 19 nt, Artificial Sequence
  Description of Artificial Sequence: Synthetic oligonucleotide
uccugucccaggcccaccg

SEQ ID NO: 12465 - RNA, 19 nt, Artificial Sequence
  Description of Artificial Sequence: Synthetic oligonucleotide
ugccugucccaggcccacc

SEQ ID NO: 12466 - RNA, 19 nt, Artificial Sequence
  Description of Artificial Sequence: Synthetic oligonucleotide
uugccugucccaggcccac

SEQ ID NO: 12467 - RNA, 19 nt, Artificial Sequence
  Description of Artificial Sequence: Synthetic oligonucleotide
ucugccugucccaggccca

SEQ ID NO: 12468 - RNA, 19 nt, Artificial Sequence
  Description of Artificial Sequence: Synthetic oligonucleotide
ugcugccugucccaggccc

SEQ ID NO: 12469 - RNA, 19 nt, Artificial Sequence
  Description of Artificial Sequence: Synthetic oligonucleotide
uagcugccugucccaggcc

SEQ ID NO: 12470 - RNA, 19 nt, Artificial Sequence
  Description of Artificial Sequence: Synthetic oligonucleotide
uuagcugccugucccaggc

SEQ ID NO: 12471 - RNA, 19 nt, Artificial Sequence
  Description of Artificial Sequence: Synthetic oligonucleotide
uguagcugccugucccagg

SEQ ID NO: 12472 - RNA, 19 nt, Artificial Sequence
  Description of Artificial Sequence: Synthetic oligonucleotide
ucguagcugccugucccag

SEQ ID NO: 12473 - RNA, 19 nt, Artificial Sequence
  Description of Artificial Sequence: Synthetic oligonucleotide
uccguagcugccuguccca

SEQ ID NO: 12474 - RNA, 19 nt, Artificial Sequence
  Description of Artificial Sequence: Synthetic oligonucleotide
ucccguagcugccuguccc

SEQ ID NO: 12475 - RNA, 19 nt, Artificial Sequence
  Description of Artificial Sequence: Synthetic oligonucleotide
ugcccguagcugccugucc

SEQ ID NO: 12476 - RNA, 19 nt, Artificial Sequence
  Description of Artificial Sequence: Synthetic oligonucleotide
uggcccguagcugccuguc

SEQ ID NO: 12477 - RNA, 19 nt, Artificial Sequence
  Description of Artificial Sequence: Synthetic oligonucleotide
ugggcccguagcugccugu

SEQ ID NO: 12478 - RNA, 19 nt, Artificial Sequence
  Description of Artificial Sequence: Synthetic oligonucleotide
ucgggcccguagcugccug

SEQ ID NO: 12479 - RNA, 19 nt, Artificial Sequence
  Description of Artificial Sequence: Synthetic oligonucleotide
uucgggcccguagcugccu

SEQ ID NO: 12480 - RNA, 19 nt, Artificial Sequence
  Description of Artificial Sequence: Synthetic oligonucleotide
ucucgggcccguagcugcc

SEQ ID NO: 12481 - RNA, 19 nt, Artificial Sequence
  Description of Artificial Sequence: Synthetic oligonucleotide
uacucgggcccguagcugc

SEQ ID NO: 12482 - RNA, 19 nt, Artificial Sequence
  Description of Artificial Sequence: Synthetic oligonucleotide
ucacucgggcccguagcug

SEQ ID NO: 12483 - RNA, 19 nt, Artificial Sequence
  Description of Artificial Sequence: Synthetic oligonucleotide
uacacucgggcccguagcu

SEQ ID NO: 12484 - RNA, 19 nt, Artificial Sequence
  Description of Artificial Sequence: Synthetic oligonucleotide
ucacacucgggcccguagc

SEQ ID NO: 12485 - RNA, 19 nt, Artificial Sequence
  Description of Artificial Sequence: Synthetic oligonucleotide
uucacacucgggcccguag

SEQ ID NO: 12486 - RNA, 19 nt, Artificial Sequence
  Description of Artificial Sequence: Synthetic oligonucleotide
ugucacacucgggcccgua

SEQ ID NO: 12487 - RNA, 19 nt, Artificial Sequence
  Description of Artificial Sequence: Synthetic oligonucleotide
uagucacacucgggcccgu

SEQ ID NO: 12488 - RNA, 19 nt, Artificial Sequence
  Description of Artificial Sequence: Synthetic oligonucleotide
ucagucacacucgggcccg

SEQ ID NO: 12489 - RNA, 19 nt, Artificial Sequence
  Description of Artificial Sequence: Synthetic oligonucleotide
uccagucacacucgggccc

SEQ ID NO: 12490 - RNA, 19 nt, Artificial Sequence
  Description of Artificial Sequence: Synthetic oligonucleotide
uaccagucacacucgggcc

SEQ ID NO: 12491 - RNA, 19 nt, Artificial Sequence
  Description of Artificial Sequence: Synthetic oligonucleotide
ucaccagucacacucgggc

SEQ ID NO: 12492 - RNA, 19 nt, Artificial Sequence
  Description of Artificial Sequence: Synthetic oligonucleotide
uccaccagucacacucggg

SEQ ID NO: 12493 - RNA, 19 nt, Artificial Sequence
  Description of Artificial Sequence: Synthetic oligonucleotide
ucccaccagucacacucgg

SEQ ID NO: 12494 - RNA, 19 nt, Artificial Sequence
  Description of Artificial Sequence: Synthetic oligonucleotide
ugcccaccagucacacucg

SEQ ID NO: 12495 - RNA, 19 nt, Artificial Sequence
  Description of Artificial Sequence: Synthetic oligonucleotide
ucgcccaccagucacacuc

SEQ ID NO: 12496 - RNA, 19 nt, Artificial Sequence
  Description of Artificial Sequence: Synthetic oligonucleotide
ugcgcccaccagucacacu

SEQ ID NO: 12497 - RNA, 19 nt, Artificial Sequence
  Description of Artificial Sequence: Synthetic oligonucleotide
uagcgcccaccagucacac

SEQ ID NO: 12498 - RNA, 19 nt, Artificial Sequence
  Description of Artificial Sequence: Synthetic oligonucleotide
ucagcgcccaccagucaca

SEQ ID NO: 12499 - RNA, 19 nt, Artificial Sequence
  Description of Artificial Sequence: Synthetic oligonucleotide
uccagcgcccaccagucac

SEQ ID NO: 12500 - RNA, 19 nt, Artificial Sequence
  Description of Artificial Sequence: Synthetic oligonucleotide
ucccagcgcccaccaguca

SEQ ID NO: 12501 - RNA, 19 nt, Artificial Sequence
  Description of Artificial Sequence: Synthetic oligonucleotide
uacccagcgcccaccaguc

SEQ ID NO: 12502 - RNA, 19 nt, Artificial Sequence
  Description of Artificial Sequence: Synthetic oligonucleotide
ucacccagcgcccaccagu

SEQ ID NO: 12503 - RNA, 19 nt, Artificial Sequence
  Description of Artificial Sequence: Synthetic oligonucleotide
uacacccagcgcccaccag

SEQ ID NO: 12504 - RNA, 19 nt, Artificial Sequence
  Description of Artificial Sequence: Synthetic oligonucleotide
uuacacccagcgcccacca

SEQ ID NO: 12505 - RNA, 19 nt, Artificial Sequence
  Description of Artificial Sequence: Synthetic oligonucleotide
uauacacccagcgcccacc

SEQ ID NO: 12506 - RNA, 19 nt, Artificial Sequence
  Description of Artificial Sequence: Synthetic oligonucleotide
uaauacacccagcgcccac

SEQ ID NO: 12507 - RNA, 19 nt, Artificial Sequence
  Description of Artificial Sequence: Synthetic oligonucleotide
ugaauacacccagcgccca

SEQ ID NO: 12508 - RNA, 19 nt, Artificial Sequence
  Description of Artificial Sequence: Synthetic oligonucleotide
ucgaauacacccagcgccc

SEQ ID NO: 12509 - RNA, 19 nt, Artificial Sequence
  Description of Artificial Sequence: Synthetic oligonucleotide
ugcgaauacacccagcgcc

SEQ ID NO: 12510 - RNA, 19 nt, Artificial Sequence
  Description of Artificial Sequence: Synthetic oligonucleotide
uggcgaauacacccagcgc

SEQ ID NO: 12511 - RNA, 19 nt, Artificial Sequence
  Description of Artificial Sequence: Synthetic oligonucleotide
uaggcgaauacacccagcg

SEQ ID NO: 12512 - RNA, 19 nt, Artificial Sequence
  Description of Artificial Sequence: Synthetic oligonucleotide
uuaggcgaauacacccagc

SEQ ID NO: 12513 - RNA, 19 nt, Artificial Sequence
  Description of Artificial Sequence: Synthetic oligonucleotide
uauaggcgaauacacccag

SEQ ID NO: 12514 - RNA, 19 nt, Artificial Sequence
  Description of Artificial Sequence: Synthetic oligonucleotide
ucauaggcgaauacaccca

SEQ ID NO: 12515 - RNA, 19 nt, Artificial Sequence
  Description of Artificial Sequence: Synthetic oligonucleotide
uucauaggcgaauacaccc

SEQ ID NO: 12516 - RNA, 19 nt, Artificial Sequence
  Description of Artificial Sequence: Synthetic oligonucleotide
uuucauaggcgaauacacc

SEQ ID NO: 12517 - RNA, 19 nt, Artificial Sequence
  Description of Artificial Sequence: Synthetic oligonucleotide
uuuucauaggcgaauacac

SEQ ID NO: 12518 - RNA, 19 nt, Artificial Sequence
  Description of Artificial Sequence: Synthetic oligonucleotide
uauuucauaggcgaauaca

SEQ ID NO: 12519 - RNA, 19 nt, Artificial Sequence
  Description of Artificial Sequence: Synthetic oligonucleotide
ucauuucauaggcgaauac

SEQ ID NO: 12520 - RNA, 19 nt, Artificial Sequence
  Description of Artificial Sequence: Synthetic oligonucleotide
uacauuucauaggcgaaua

SEQ ID NO: 12521 - RNA, 19 nt, Artificial Sequence
  Description of Artificial Sequence: Synthetic oligonucleotide
uaacauuucauaggcgaau

SEQ ID NO: 12522 - RNA, 19 nt, Artificial Sequence
  Description of Artificial Sequence: Synthetic oligonucleotide
ugaacauuucauaggcgaa

SEQ ID NO: 12523 - RNA, 19 nt, Artificial Sequence
  Description of Artificial Sequence: Synthetic oligonucleotide
uagaacauuucauaggcga

SEQ ID NO: 12524 - RNA, 19 nt, Artificial Sequence
  Description of Artificial Sequence: Synthetic oligonucleotide
uuagaacauuucauaggcg

SEQ ID NO: 12525 - RNA, 19 nt, Artificial Sequence
  Description of Artificial Sequence: Synthetic oligonucleotide
uauagaacauuucauaggc

SEQ ID NO: 12526 - RNA, 19 nt, Artificial Sequence
  Description of Artificial Sequence: Synthetic oligonucleotide
ucauagaacauuucauagg

SEQ ID NO: 12527 - RNA, 19 nt, Artificial Sequence
  Description of Artificial Sequence: Synthetic oligonucleotide
uccauagaacauuucauag

SEQ ID NO: 12528 - RNA, 19 nt, Artificial Sequence
  Description of Artificial Sequence: Synthetic oligonucleotide
ucccauagaacauuucaua

SEQ ID NO: 12529 - RNA, 19 nt, Artificial Sequence
  Description of Artificial Sequence: Synthetic oligonucleotide
ugcccauagaacauuucau

SEQ ID NO: 12530 - RNA, 19 nt, Artificial Sequence
  Description of Artificial Sequence: Synthetic oligonucleotide
uugcccauagaacauuuca

SEQ ID NO: 12531 - RNA, 19 nt, Artificial Sequence
  Description of Artificial Sequence: Synthetic oligonucleotide
ucugcccauagaacauuuc

SEQ ID NO: 12532 - RNA, 19 nt, Artificial Sequence
  Description of Artificial Sequence: Synthetic oligonucleotide
uucugcccauagaacauuu

SEQ ID NO: 12533 - RNA, 19 nt, Artificial Sequence
  Description of Artificial Sequence: Synthetic oligonucleotide
ugucugcccauagaacauu

SEQ ID NO: 12534 - RNA, 19 nt, Artificial Sequence
  Description of Artificial Sequence: Synthetic oligonucleotide
ucgucugcccauagaacau

SEQ ID NO: 12535 - RNA, 19 nt, Artificial Sequence
  Description of Artificial Sequence: Synthetic oligonucleotide
ugcgucugcccauagaaca

SEQ ID NO: 12536 - RNA, 19 nt, Artificial Sequence
  Description of Artificial Sequence: Synthetic oligonucleotide
uggcgucugcccauagaac

SEQ ID NO: 12537 - RNA, 19 nt, Artificial Sequence
  Description of Artificial Sequence: Synthetic oligonucleotide
ugggcgucugcccauagaa

SEQ ID NO: 12538 - RNA, 19 nt, Artificial Sequence
  Description of Artificial Sequence: Synthetic oligonucleotide
uagggcgucugcccauaga

SEQ ID NO: 12539 - RNA, 19 nt, Artificial Sequence
  Description of Artificial Sequence: Synthetic oligonucleotide
uaagggcgucugcccauag

SEQ ID NO: 12540 - RNA, 19 nt, Artificial Sequence
  Description of Artificial Sequence: Synthetic oligonucleotide
ugaagggcgucugcccaua

SEQ ID NO: 12541 - RNA, 19 nt, Artificial Sequence
  Description of Artificial Sequence: Synthetic oligonucleotide
uagaagggcgucugcccau

SEQ ID NO: 12542 - RNA, 19 nt, Artificial Sequence
  Description of Artificial Sequence: Synthetic oligonucleotide
uuagaagggcgucugccca

SEQ ID NO: 12543 - RNA, 19 nt, Artificial Sequence
  Description of Artificial Sequence: Synthetic oligonucleotide
uguagaagggcgucugccc

SEQ ID NO: 12544 - RNA, 19 nt, Artificial Sequence
  Description of Artificial Sequence: Synthetic oligonucleotide
ucguagaagggcgucugcc

SEQ ID NO: 12545 - RNA, 19 nt, Artificial Sequence
  Description of Artificial Sequence: Synthetic oligonucleotide
ugcguagaagggcgucugc

SEQ ID NO: 12546 - RNA, 19 nt, Artificial Sequence
  Description of Artificial Sequence: Synthetic oligonucleotide
ucgcguagaagggcgucug

SEQ ID NO: 12547 - RNA, 19 nt, Artificial Sequence
  Description of Artificial Sequence: Synthetic oligonucleotide
uccgcguagaagggcgucu

SEQ ID NO: 12548 - RNA, 19 nt, Artificial Sequence
  Description of Artificial Sequence: Synthetic oligonucleotide
uuccgcguagaagggcguc

SEQ ID NO: 12549 - RNA, 19 nt, Artificial Sequence
  Description of Artificial Sequence: Synthetic oligonucleotide
uauccgcguagaagggcgu

SEQ ID NO: 12550 - RNA, 19 nt, Artificial Sequence
  Description of Artificial Sequence: Synthetic oligonucleotide
uaauccgcguagaagggcg

SEQ ID NO: 12551 - RNA, 19 nt, Artificial Sequence
  Description of Artificial Sequence: Synthetic oligonucleotide
ugaauccgcguagaagggc

SEQ ID NO: 12552 - RNA, 19 nt, Artificial Sequence
  Description of Artificial Sequence: Synthetic oligonucleotide
uggaauccgcguagaaggg

SEQ ID NO: 12553 - RNA, 19 nt, Artificial Sequence
  Description of Artificial Sequence: Synthetic oligonucleotide
uuggaauccgcguagaagg

SEQ ID NO: 12554 - RNA, 19 nt, Artificial Sequence
  Description of Artificial Sequence: Synthetic oligonucleotide
uguggaauccgcguagaag

SEQ ID NO: 12555 - RNA, 19 nt, Artificial Sequence
  Description of Artificial Sequence: Synthetic oligonucleotide
ucguggaauccgcguagaa

SEQ ID NO: 12556 - RNA, 19 nt, Artificial Sequence
  Description of Artificial Sequence: Synthetic oligonucleotide
uccguggaauccgcguaga

SEQ ID NO: 12557 - RNA, 19 nt, Artificial Sequence
  Description of Artificial Sequence: Synthetic oligonucleotide
ugccguggaauccgcguag

SEQ ID NO: 12558 - RNA, 19 nt, Artificial Sequence
  Description of Artificial Sequence: Synthetic oligonucleotide
ucgccguggaauccgcgua

SEQ ID NO: 12559 - RNA, 19 nt, Artificial Sequence
  Description of Artificial Sequence: Synthetic oligonucleotide
uccgccguggaauccgcgu

SEQ ID NO: 12560 - RNA, 19 nt, Artificial Sequence
  Description of Artificial Sequence: Synthetic oligonucleotide
uuccgccguggaauccgcg

SEQ ID NO: 12561 - RNA, 19 nt, Artificial Sequence
  Description of Artificial Sequence: Synthetic oligonucleotide
ucuccgccguggaauccgc

SEQ ID NO: 12562 - RNA, 19 nt, Artificial Sequence
  Description of Artificial Sequence: Synthetic oligonucleotide
uucuccgccguggaauccg

SEQ ID NO: 12563 - RNA, 19 nt, Artificial Sequence
  Description of Artificial Sequence: Synthetic oligonucleotide
ugucuccgccguggaaucc

SEQ ID NO: 12564 - RNA, 19 nt, Artificial Sequence
  Description of Artificial Sequence: Synthetic oligonucleotide
uggucuccgccguggaauc

SEQ ID NO: 12565 - RNA, 19 nt, Artificial Sequence
  Description of Artificial Sequence: Synthetic oligonucleotide
uaggucuccgccguggaau

SEQ ID NO: 12566 - RNA, 19 nt, Artificial Sequence
  Description of Artificial Sequence: Synthetic oligonucleotide
uuaggucuccgccguggaa

SEQ ID NO: 12567 - RNA, 19 nt, Artificial Sequence
  Description of Artificial Sequence: Synthetic oligonucleotide
uauaggucuccgccgugga

SEQ ID NO: 12568 - RNA, 19 nt, Artificial Sequence
  Description of Artificial Sequence: Synthetic oligonucleotide
ucauaggucuccgccgugg

SEQ ID NO: 12569 - RNA, 19 nt, Artificial Sequence
  Description of Artificial Sequence: Synthetic oligonucleotide
uccauaggucuccgccgug

SEQ ID NO: 12570 - RNA, 19 nt, Artificial Sequence
  Description of Artificial Sequence: Synthetic oligonucleotide
ugccauaggucuccgccgu

SEQ ID NO: 12571 - RNA, 19 nt, Artificial Sequence
  Description of Artificial Sequence: Synthetic oligonucleotide
uugccauaggucuccgccg

SEQ ID NO: 12572 - RNA, 19 nt, Artificial Sequence
  Description of Artificial Sequence: Synthetic oligonucleotide
uuugccauaggucuccgcc

SEQ ID NO: 12573 - RNA, 19 nt, Artificial Sequence
  Description of Artificial Sequence: Synthetic oligonucleotide
ucuugccauaggucuccgc

SEQ ID NO: 12574 - RNA, 19 nt, Artificial Sequence
  Description of Artificial Sequence: Synthetic oligonucleotide
uucuugccauaggucuccg

SEQ ID NO: 12575 - RNA, 19 nt, Artificial Sequence
  Description of Artificial Sequence: Synthetic oligonucleotide
uaucuugccauaggucucc

SEQ ID NO: 12576 - RNA, 19 nt, Artificial Sequence
  Description of Artificial Sequence: Synthetic oligonucleotide
ugaucuugccauaggucuc

SEQ ID NO: 12577 - RNA, 19 nt, Artificial Sequence
  Description of Artificial Sequence: Synthetic oligonucleotide
ucgaucuugccauaggucu

SEQ ID NO: 12578 - RNA, 19 nt, Artificial Sequence
  Description of Artificial Sequence: Synthetic oligonucleotide
uacgaucuugccauagguc

SEQ ID NO: 12579 - RNA, 19 nt, Artificial Sequence
  Description of Artificial Sequence: Synthetic oligonucleotide
ugacgaucuugccauaggu

SEQ ID NO: 12580 - RNA, 19 nt, Artificial Sequence
  Description of Artificial Sequence: Synthetic oligonucleotide
uggacgaucuugccauagg

SEQ ID NO: 12581 - RNA, 19 nt, Artificial Sequence
  Description of Artificial Sequence: Synthetic oligonucleotide
uuggacgaucuugccauag

SEQ ID NO: 12582 - RNA, 19 nt, Artificial Sequence
  Description of Artificial Sequence: Synthetic oligonucleotide
uguggacgaucuugccaua

SEQ ID NO: 12583 - RNA, 19 nt, Artificial Sequence
  Description of Artificial Sequence: Synthetic oligonucleotide
uaguggacgaucuugccau

SEQ ID NO: 12584 - RNA, 19 nt, Artificial Sequence
  Description of Artificial Sequence: Synthetic oligonucleotide
uuaguggacgaucuugcca

SEQ ID NO: 12585 - RNA, 19 nt, Artificial Sequence
  Description of Artificial Sequence: Synthetic oligonucleotide
uguaguggacgaucuugcc

SEQ ID NO: 12586 - RNA, 19 nt, Artificial Sequence
  Description of Artificial Sequence: Synthetic oligonucleotide
uuguaguggacgaucuugc

SEQ ID NO: 12587 - RNA, 19 nt, Artificial Sequence
  Description of Artificial Sequence: Synthetic oligonucleotide
uuuguaguggacgaucuug

SEQ ID NO: 12588 - RNA, 19 nt, Artificial Sequence
  Description of Artificial Sequence: Synthetic oligonucleotide
ucuuguaguggacgaucuu

SEQ ID NO: 12589 - RNA, 19 nt, Artificial Sequence
  Description of Artificial Sequence: Synthetic oligonucleotide
uccuuguaguggacgaucu

SEQ ID NO: 12590 - RNA, 19 nt, Artificial Sequence
  Description of Artificial Sequence: Synthetic oligonucleotide
uuccuuguaguggacgauc

SEQ ID NO: 12591 - RNA, 19 nt, Artificial Sequence
  Description of Artificial Sequence: Synthetic oligonucleotide
ucuccuuguaguggacgau

SEQ ID NO: 12592 - RNA, 19 nt, Artificial Sequence
  Description of Artificial Sequence: Synthetic oligonucleotide
ugcuccuuguaguggacga

SEQ ID NO: 12593 - RNA, 19 nt, Artificial Sequence
  Description of Artificial Sequence: Synthetic oligonucleotide
uugcuccuuguaguggacg

SEQ ID NO: 12594 - RNA, 19 nt, Artificial Sequence
  Description of Artificial Sequence: Synthetic oligonucleotide
ugugcuccuuguaguggac

SEQ ID NO: 12595 - RNA, 19 nt, Artificial Sequence
  Description of Artificial Sequence: Synthetic oligonucleotide
uggugcuccuuguagugga

SEQ ID NO: 12596 - RNA, 19 nt, Artificial Sequence
  Description of Artificial Sequence: Synthetic oligonucleotide
uaggugcuccuuguagugg

SEQ ID NO: 12597 - RNA, 19 nt, Artificial Sequence
  Description of Artificial Sequence: Synthetic oligonucleotide
ugaggugcuccuuguagug

SEQ ID NO: 12598 - RNA, 19 nt, Artificial Sequence
  Description of Artificial Sequence: Synthetic oligonucleotide
uagaggugcuccuuguagu

SEQ ID NO: 12599 - RNA, 19 nt, Artificial Sequence
  Description of Artificial Sequence: Synthetic oligonucleotide
ugagaggugcuccuuguag

SEQ ID NO: 12600 - RNA, 19 nt, Artificial Sequence
  Description of Artificial Sequence: Synthetic oligonucleotide
uagagaggugcuccuugua

SEQ ID NO: 12601 - RNA, 19 nt, Artificial Sequence
  Description of Artificial Sequence: Synthetic oligonucleotide
ugagagaggugcuccuugu

SEQ ID NO: 12602 - RNA, 19 nt, Artificial Sequence
  Description of Artificial Sequence: Synthetic oligonucleotide
uagagagaggugcuccuug

SEQ ID NO: 12603 - RNA, 19 nt, Artificial Sequence
  Description of Artificial Sequence: Synthetic oligonucleotide
ucagagagaggugcuccuu

SEQ ID NO: 12604 - RNA, 19 nt, Artificial Sequence
  Description of Artificial Sequence: Synthetic oligonucleotide
ugcagagagaggugcuccu

SEQ ID NO: 12605 - RNA, 19 nt, Artificial Sequence
  Description of Artificial Sequence: Synthetic oligonucleotide
uggcagagagaggugcucc

SEQ ID NO: 12606 - RNA, 19 nt, Artificial Sequence
  Description of Artificial Sequence: Synthetic oligonucleotide
ucggcagagagaggugcuc

SEQ ID NO: 12607 - RNA, 19 nt, Artificial Sequence
  Description of Artificial Sequence: Synthetic oligonucleotide
ugcggcagagagaggugcu

SEQ ID NO: 12608 - RNA, 19 nt, Artificial Sequence
  Description of Artificial Sequence: Synthetic oligonucleotide
uagcggcagagagaggugc

SEQ ID NO: 12609 - RNA, 19 nt, Artificial Sequence
  Description of Artificial Sequence: Synthetic oligonucleotide
ucagcggcagagagaggug

SEQ ID NO: 12610 - RNA, 19 nt, Artificial Sequence
  Description of Artificial Sequence: Synthetic oligonucleotide
uccagcggcagagagaggu

SEQ ID NO: 12611 - RNA, 19 nt, Artificial Sequence
  Description of Artificial Sequence: Synthetic oligonucleotide
uaccagcggcagagagagg

SEQ ID NO: 12612 - RNA, 19 nt, Artificial Sequence
  Description of Artificial Sequence: Synthetic oligonucleotide
ucaccagcggcagagagag

SEQ ID NO: 12613 - RNA, 19 nt, Artificial Sequence
  Description of Artificial Sequence: Synthetic oligonucleotide
uccaccagcggcagagaga

SEQ ID NO: 12614 - RNA, 19 nt, Artificial Sequence
  Description of Artificial Sequence: Synthetic oligonucleotide
uuccaccagcggcagagag

SEQ ID NO: 12615 - RNA, 19 nt, Artificial Sequence
  Description of Artificial Sequence: Synthetic oligonucleotide
uguccaccagcggcagaga

SEQ ID NO: 12616 - RNA, 19 nt, Artificial Sequence
  Description of Artificial Sequence: Synthetic oligonucleotide
ucguccaccagcggcagag

SEQ ID NO: 12617 - RNA, 19 nt, Artificial Sequence
  Description of Artificial Sequence: Synthetic oligonucleotide
uucguccaccagcggcaga

SEQ ID NO: 12618 - RNA, 19 nt, Artificial Sequence
  Description of Artificial Sequence: Synthetic oligonucleotide
uuucguccaccagcggcag

SEQ ID NO: 12619 - RNA, 19 nt, Artificial Sequence
  Description of Artificial Sequence: Synthetic oligonucleotide
ucuucguccaccagcggca

SEQ ID NO: 12620 - RNA, 19 nt, Artificial Sequence
  Description of Artificial Sequence: Synthetic oligonucleotide
uccuucguccaccagcggc

SEQ ID NO: 12621 - RNA, 19 nt, Artificial Sequence
  Description of Artificial Sequence: Synthetic oligonucleotide
ucccuucguccaccagcgg

SEQ ID NO: 12622 - RNA, 19 nt, Artificial Sequence
  Description of Artificial Sequence: Synthetic oligonucleotide
uccccuucguccaccagcg

SEQ ID NO: 12623 - RNA, 19 nt, Artificial Sequence
  Description of Artificial Sequence: Synthetic oligonucleotide
uaccccuucguccaccagc

SEQ ID NO: 12624 - RNA, 19 nt, Artificial Sequence
  Description of Artificial Sequence: Synthetic oligonucleotide
ugaccccuucguccaccag

SEQ ID NO: 12625 - RNA, 19 nt, Artificial Sequence
  Description of Artificial Sequence: Synthetic oligonucleotide
uggaccccuucguccacca

SEQ ID NO: 12626 - RNA, 19 nt, Artificial Sequence
  Description of Artificial Sequence: Synthetic oligonucleotide
ugggaccccuucguccacc

SEQ ID NO: 12627 - RNA, 19 nt, Artificial Sequence
  Description of Artificial Sequence: Synthetic oligonucleotide
uagggaccccuucguccac

SEQ ID NO: 12628 - RNA, 19 nt, Artificial Sequence
  Description of Artificial Sequence: Synthetic oligonucleotide
ucagggaccccuucgucca

SEQ ID NO: 12629 - RNA, 19 nt, Artificial Sequence
  Description of Artificial Sequence: Synthetic oligonucleotide
uucagggaccccuucgucc

SEQ ID NO: 12630 - RNA, 19 nt, Artificial Sequence
  Description of Artificial Sequence: Synthetic oligonucleotide
ucucagggaccccuucguc

SEQ ID NO: 12631 - RNA, 19 nt, Artificial Sequence
  Description of Artificial Sequence: Synthetic oligonucleotide
uccucagggaccccuucgu

SEQ ID NO: 12632 - RNA, 19 nt, Artificial Sequence
  Description of Artificial Sequence: Synthetic oligonucleotide
uuccucagggaccccuucg

SEQ ID NO: 12633 - RNA, 19 nt, Artificial Sequence
  Description of Artificial Sequence: Synthetic oligonucleotide
ucuccucagggaccccuuc

SEQ ID NO: 12634 - RNA, 19 nt, Artificial Sequence
  Description of Artificial Sequence: Synthetic oligonucleotide
uccuccucagggaccccuu

SEQ ID NO: 12635 - RNA, 19 nt, Artificial Sequence
  Description of Artificial Sequence: Synthetic oligonucleotide
ugccuccucagggaccccu

SEQ ID NO: 12636 - RNA, 19 nt, Artificial Sequence
  Description of Artificial Sequence: Synthetic oligonucleotide
uagccuccucagggacccc

SEQ ID NO: 12637 - RNA, 19 nt, Artificial Sequence
  Description of Artificial Sequence: Synthetic oligonucleotide
ugagccuccucagggaccc

SEQ ID NO: 12638 - RNA, 19 nt, Artificial Sequence
  Description of Artificial Sequence: Synthetic oligonucleotide
ucgagccuccucagggacc

SEQ ID NO: 12639 - RNA, 19 nt, Artificial Sequence
  Description of Artificial Sequence: Synthetic oligonucleotide
uucgagccuccucagggac

SEQ ID NO: 12640 - RNA, 19 nt, Artificial Sequence
  Description of Artificial Sequence: Synthetic oligonucleotide
ucucgagccuccucaggga

SEQ ID NO: 12641 - RNA, 19 nt, Artificial Sequence
  Description of Artificial Sequence: Synthetic oligonucleotide
uucucgagccuccucaggg

SEQ ID NO: 12642 - RNA, 19 nt, Artificial Sequence
  Description of Artificial Sequence: Synthetic oligonucleotide
ugucucgagccuccucagg

SEQ ID NO: 12643 - RNA, 19 nt, Artificial Sequence
  Description of Artificial Sequence: Synthetic oligonucleotide
uagucucgagccuccucag

SEQ ID NO: 12644 - RNA, 19 nt, Artificial Sequence
  Description of Artificial Sequence: Synthetic oligonucleotide
uaagucucgagccuccuca

SEQ ID NO: 12645 - RNA, 19 nt, Artificial Sequence
  Description of Artificial Sequence: Synthetic oligonucleotide
ugaagucucgagccuccuc

SEQ ID NO: 12646 - RNA, 19 nt, Artificial Sequence
  Description of Artificial Sequence: Synthetic oligonucleotide
uugaagucucgagccuccu

SEQ ID NO: 12647 - RNA, 19 nt, Artificial Sequence
  Description of Artificial Sequence: Synthetic oligonucleotide
uaugaagucucgagccucc

SEQ ID NO: 12648 - RNA, 19 nt, Artificial Sequence
  Description of Artificial Sequence: Synthetic oligonucleotide
uaaugaagucucgagccuc

SEQ ID NO: 12649 - RNA, 19 nt, Artificial Sequence
  Description of Artificial Sequence: Synthetic oligonucleotide
ugaaugaagucucgagccu

SEQ ID NO: 12650 - RNA, 19 nt, Artificial Sequence
  Description of Artificial Sequence: Synthetic oligonucleotide
uugaaugaagucucgagcc

SEQ ID NO: 12651 - RNA, 19 nt, Artificial Sequence
  Description of Artificial Sequence: Synthetic oligonucleotide
ucugaaugaagucucgagc

SEQ ID NO: 12652 - RNA, 19 nt, Artificial Sequence
  Description of Artificial Sequence: Synthetic oligonucleotide
ugcugaaugaagucucgag

SEQ ID NO: 12653 - RNA, 19 nt, Artificial Sequence
  Description of Artificial Sequence: Synthetic oligonucleotide
ucgcugaaugaagucucga

SEQ ID NO: 12654 - RNA, 19 nt, Artificial Sequence
  Description of Artificial Sequence: Synthetic oligonucleotide
uccgcugaaugaagucucg

SEQ ID NO: 12655 - RNA, 19 nt, Artificial Sequence
  Description of Artificial Sequence: Synthetic oligonucleotide
uaccgcugaaugaagucuc

SEQ ID NO: 12656 - RNA, 19 nt, Artificial Sequence
  Description of Artificial Sequence: Synthetic oligonucleotide
uaaccgcugaaugaagucu

SEQ ID NO: 12657 - RNA, 19 nt, Artificial Sequence
  Description of Artificial Sequence: Synthetic oligonucleotide
ucaaccgcugaaugaaguc

SEQ ID NO: 12658 - RNA, 19 nt, Artificial Sequence
  Description of Artificial Sequence: Synthetic oligonucleotide
ugcaaccgcugaaugaagu

SEQ ID NO: 12659 - RNA, 19 nt, Artificial Sequence
  Description of Artificial Sequence: Synthetic oligonucleotide
uagcaaccgcugaaugaag

SEQ ID NO: 12660 - RNA, 19 nt, Artificial Sequence
  Description of Artificial Sequence: Synthetic oligonucleotide
ucagcaaccgcugaaugaa

SEQ ID NO: 12661 - RNA, 19 nt, Artificial Sequence
  Description of Artificial Sequence: Synthetic oligonucleotide
uacagcaaccgcugaauga

SEQ ID NO: 12662 - RNA, 19 nt, Artificial Sequence
  Description of Artificial Sequence: Synthetic oligonucleotide
ucacagcaaccgcugaaug

SEQ ID NO: 12663 - RNA, 19 nt, Artificial Sequence
  Description of Artificial Sequence: Synthetic oligonucleotide
uacacagcaaccgcugaau

SEQ ID NO: 12664 - RNA, 19 nt, Artificial Sequence
  Description of Artificial Sequence: Synthetic oligonucleotide
ugacacagcaaccgcugaa

SEQ ID NO: 12665 - RNA, 19 nt, Artificial Sequence
  Description of Artificial Sequence: Synthetic oligonucleotide
uggacacagcaaccgcuga

SEQ ID NO: 12666 - RNA, 19 nt, Artificial Sequence
  Description of Artificial Sequence: Synthetic oligonucleotide
ugggacacagcaaccgcug

SEQ ID NO: 12667 - RNA, 19 nt, Artificial Sequence
  Description of Artificial Sequence: Synthetic oligonucleotide
uggggacacagcaaccgcu

SEQ ID NO: 12668 - RNA, 19 nt, Artificial Sequence
  Description of Artificial Sequence: Synthetic oligonucleotide
ugggggacacagcaaccgc

SEQ ID NO: 12669 - RNA, 19 nt, Artificial Sequence
  Description of Artificial Sequence: Synthetic oligonucleotide
ucgggggacacagcaaccg

SEQ ID NO: 12670 - RNA, 19 nt, Artificial Sequence
  Description of Artificial Sequence: Synthetic oligonucleotide
uccgggggacacagcaacc

SEQ ID NO: 12671 - RNA, 19 nt, Artificial Sequence
  Description of Artificial Sequence: Synthetic oligonucleotide
uuccgggggacacagcaac

SEQ ID NO: 12672 - RNA, 19 nt, Artificial Sequence
  Description of Artificial Sequence: Synthetic oligonucleotide
ucuccgggggacacagcaa

SEQ ID NO: 12673 - RNA, 19 nt, Artificial Sequence
  Description of Artificial Sequence: Synthetic oligonucleotide
uucuccgggggacacagca

SEQ ID NO: 12674 - RNA, 19 nt, Artificial Sequence
  Description of Artificial Sequence: Synthetic oligonucleotide
ugucuccgggggacacagc

SEQ ID NO: 12675 - RNA, 19 nt, Artificial Sequence
  Description of Artificial Sequence: Synthetic oligonucleotide
uugucuccgggggacacag

SEQ ID NO: 12676 - RNA, 19 nt, Artificial Sequence
  Description of Artificial Sequence: Synthetic oligonucleotide
ugugucuccgggggacaca

SEQ ID NO: 12677 - RNA, 19 nt, Artificial Sequence
  Description of Artificial Sequence: Synthetic oligonucleotide
ucgugucuccgggggacac

SEQ ID NO: 12678 - RNA, 19 nt, Artificial Sequence
  Description of Artificial Sequence: Synthetic oligonucleotide
uccgugucuccgggggaca

SEQ ID NO: 12679 - RNA, 19 nt, Artificial Sequence
  Description of Artificial Sequence: Synthetic oligonucleotide
ugccgugucuccgggggac

SEQ ID NO: 12680 - RNA, 19 nt, Artificial Sequence
  Description of Artificial Sequence: Synthetic oligonucleotide
uagccgugucuccggggga

SEQ ID NO: 12681 - RNA, 19 nt, Artificial Sequence
  Description of Artificial Sequence: Synthetic oligonucleotide
ucagccgugucuccggggg

SEQ ID NO: 12682 - RNA, 19 nt, Artificial Sequence
  Description of Artificial Sequence: Synthetic oligonucleotide
uccagccgugucuccgggg

SEQ ID NO: 12683 - RNA, 19 nt, Artificial Sequence
  Description of Artificial Sequence: Synthetic oligonucleotide
ucccagccgugucuccggg

SEQ ID NO: 12684 - RNA, 19 nt, Artificial Sequence
  Description of Artificial Sequence: Synthetic oligonucleotide
ugcccagccgugucuccgg

SEQ ID NO: 12685 - RNA, 19 nt, Artificial Sequence
  Description of Artificial Sequence: Synthetic oligonucleotide
uggcccagccgugucuccg

SEQ ID NO: 12686 - RNA, 19 nt, Artificial Sequence
  Description of Artificial Sequence: Synthetic oligonucleotide
ucggcccagccgugucucc

SEQ ID NO: 12687 - RNA, 19 nt, Artificial Sequence
  Description of Artificial Sequence: Synthetic oligonucleotide
uccggcccagccgugucuc

SEQ ID NO: 12688 - RNA, 19 nt, Artificial Sequence
  Description of Artificial Sequence: Synthetic oligonucleotide
ucccggcccagccgugucu

SEQ ID NO: 12689 - RNA, 19 nt, Artificial Sequence
  Description of Artificial Sequence: Synthetic oligonucleotide
uccccggcccagccguguc

SEQ ID NO: 12690 - RNA, 19 nt, Artificial Sequence
  Description of Artificial Sequence: Synthetic oligonucleotide
uaccccggcccagccgugu

SEQ ID NO: 12691 - RNA, 19 nt, Artificial Sequence
  Description of Artificial Sequence: Synthetic oligonucleotide
ucaccccggcccagccgug

SEQ ID NO: 12692 - RNA, 19 nt, Artificial Sequence
  Description of Artificial Sequence: Synthetic oligonucleotide
uccaccccggcccagccgu

SEQ ID NO: 12693 - RNA, 19 nt, Artificial Sequence
  Description of Artificial Sequence: Synthetic oligonucleotide
uuccaccccggcccagccg

SEQ ID NO: 12694 - RNA, 19 nt, Artificial Sequence
  Description of Artificial Sequence: Synthetic oligonucleotide
ucuccaccccggcccagcc

SEQ ID NO: 12695 - RNA, 19 nt, Artificial Sequence
  Description of Artificial Sequence: Synthetic oligonucleotide
ugcuccaccccggcccagc

SEQ ID NO: 12696 - RNA, 19 nt, Artificial Sequence
  Description of Artificial Sequence: Synthetic oligonucleotide
uugcuccaccccggcccag

SEQ ID NO: 12697 - RNA, 19 nt, Artificial Sequence
  Description of Artificial Sequence: Synthetic oligonucleotide
ucugcuccaccccggccca

SEQ ID NO: 12698 - RNA, 19 nt, Artificial Sequence
  Description of Artificial Sequence: Synthetic oligonucleotide
uccugcuccaccccggccc

SEQ ID NO: 12699 - RNA, 19 nt, Artificial Sequence
  Description of Artificial Sequence: Synthetic oligonucleotide
ugccugcuccaccccggcc

SEQ ID NO: 12700 - RNA, 19 nt, Artificial Sequence
  Description of Artificial Sequence: Synthetic oligonucleotide
ucgccugcuccaccccggc

SEQ ID NO: 12701 - RNA, 19 nt, Artificial Sequence
  Description of Artificial Sequence: Synthetic oligonucleotide
uucgccugcuccaccccgg

SEQ ID NO: 12702 - RNA, 19 nt, Artificial Sequence
  Description of Artificial Sequence: Synthetic oligonucleotide
ugucgccugcuccaccccg

SEQ ID NO: 12703 - RNA, 19 nt, Artificial Sequence
  Description of Artificial Sequence: Synthetic oligonucleotide
uagucgccugcuccacccc

SEQ ID NO: 12704 - RNA, 19 nt, Artificial Sequence
  Description of Artificial Sequence: Synthetic oligonucleotide
uaagucgccugcuccaccc

SEQ ID NO: 12705 - RNA, 19 nt, Artificial Sequence
  Description of Artificial Sequence: Synthetic oligonucleotide
ugaagucgccugcuccacc

SEQ ID NO: 12706 - RNA, 19 nt, Artificial Sequence
  Description of Artificial Sequence: Synthetic oligonucleotide
uggaagucgccugcuccac

SEQ ID NO: 12707 - RNA, 19 nt, Artificial Sequence
  Description of Artificial Sequence: Synthetic oligonucleotide
ucggaagucgccugcucca

SEQ ID NO: 12708 - RNA, 19 nt, Artificial Sequence
  Description of Artificial Sequence: Synthetic oligonucleotide
uccggaagucgccugcucc

SEQ ID NO: 12709 - RNA, 19 nt, Artificial Sequence
  Description of Artificial Sequence: Synthetic oligonucleotide
uuccggaagucgccugcuc

SEQ ID NO: 12710 - RNA, 19 nt, Artificial Sequence
  Description of Artificial Sequence: Synthetic oligonucleotide
uguccggaagucgccugcu

SEQ ID NO: 12711 - RNA, 19 nt, Artificial Sequence
  Description of Artificial Sequence: Synthetic oligonucleotide
uuguccggaagucgccugc

SEQ ID NO: 12712 - RNA, 19 nt, Artificial Sequence
  Description of Artificial Sequence: Synthetic oligonucleotide
uguguccggaagucgccug

SEQ ID NO: 12713 - RNA, 19 nt, Artificial Sequence
  Description of Artificial Sequence: Synthetic oligonucleotide
uuguguccggaagucgccu

SEQ ID NO: 12714 - RNA, 19 nt, Artificial Sequence
  Description of Artificial Sequence: Synthetic oligonucleotide
uauguguccggaagucgcc

SEQ ID NO: 12715 - RNA, 19 nt, Artificial Sequence
  Description of Artificial Sequence: Synthetic oligonucleotide
ugauguguccggaagucgc

SEQ ID NO: 12716 - RNA, 19 nt, Artificial Sequence
  Description of Artificial Sequence: Synthetic oligonucleotide
uggauguguccggaagucg

SEQ ID NO: 12717 - RNA, 19 nt, Artificial Sequence
  Description of Artificial Sequence: Synthetic oligonucleotide
ugggauguguccggaaguc

SEQ ID NO: 12718 - RNA, 19 nt, Artificial Sequence
  Description of Artificial Sequence: Synthetic oligonucleotide
uagggauguguccggaagu

SEQ ID NO: 12719 - RNA, 19 nt, Artificial Sequence
  Description of Artificial Sequence: Synthetic oligonucleotide
uaagggauguguccggaag

SEQ ID NO: 12720 - RNA, 19 nt, Artificial Sequence
  Description of Artificial Sequence: Synthetic oligonucleotide
ugaagggauguguccggaa

SEQ ID NO: 12721 - RNA, 19 nt, Artificial Sequence
  Description of Artificial Sequence: Synthetic oligonucleotide
uagaagggauguguccgga

SEQ ID NO: 12722 - RNA, 19 nt, Artificial Sequence
  Description of Artificial Sequence: Synthetic oligonucleotide
uaagaagggauguguccgg

SEQ ID NO: 12723 - RNA, 19 nt, Artificial Sequence
  Description of Artificial Sequence: Synthetic oligonucleotide
ugaagaagggauguguccg

SEQ ID NO: 12724 - RNA, 19 nt, Artificial Sequence
  Description of Artificial Sequence: Synthetic oligonucleotide
uagaagaagggaugugucc

SEQ ID NO: 12725 - RNA, 19 nt, Artificial Sequence
  Description of Artificial Sequence: Synthetic oligonucleotide
uaagaagaagggauguguc

SEQ ID NO: 12726 - RNA, 19 nt, Artificial Sequence
  Description of Artificial Sequence: Synthetic oligonucleotide
uaaagaagaagggaugugu

SEQ ID NO: 12727 - RNA, 19 nt, Artificial Sequence
  Description of Artificial Sequence: Synthetic oligonucleotide
ucaaagaagaagggaugug

SEQ ID NO: 12728 - RNA, 19 nt, Artificial Sequence
  Description of Artificial Sequence: Synthetic oligonucleotide
uccaaagaagaagggaugu

SEQ ID NO: 12729 - RNA, 19 nt, Artificial Sequence
  Description of Artificial Sequence: Synthetic oligonucleotide
ugccaaagaagaagggaug

SEQ ID NO: 12730 - RNA, 19 nt, Artificial Sequence
  Description of Artificial Sequence: Synthetic oligonucleotide
uggccaaagaagaagggau

SEQ ID NO: 12731 - RNA, 19 nt, Artificial Sequence
  Description of Artificial Sequence: Synthetic oligonucleotide
uaggccaaagaagaaggga

SEQ ID NO: 12732 - RNA, 19 nt, Artificial Sequence
  Description of Artificial Sequence: Synthetic oligonucleotide
ugaggccaaagaagaaggg

SEQ ID NO: 12733 - RNA, 19 nt, Artificial Sequence
  Description of Artificial Sequence: Synthetic oligonucleotide
ucgaggccaaagaagaagg

SEQ ID NO: 12734 - RNA, 19 nt, Artificial Sequence
  Description of Artificial Sequence: Synthetic oligonucleotide
uucgaggccaaagaagaag

SEQ ID NO: 12735 - RNA, 19 nt, Artificial Sequence
  Description of Artificial Sequence: Synthetic oligonucleotide
ugucgaggccaaagaagaa

SEQ ID NO: 12736 - RNA, 19 nt, Artificial Sequence
  Description of Artificial Sequence: Synthetic oligonucleotide
uagucgaggccaaagaaga

SEQ ID NO: 12737 - RNA, 19 nt, Artificial Sequence
  Description of Artificial Sequence: Synthetic oligonucleotide
ucagucgaggccaaagaag

SEQ ID NO: 12738 - RNA, 19 nt, Artificial Sequence
  Description of Artificial Sequence: Synthetic oligonucleotide
uccagucgaggccaaagaa

SEQ ID NO: 12739 - RNA, 19 nt, Artificial Sequence
  Description of Artificial Sequence: Synthetic oligonucleotide
ucccagucgaggccaaaga

SEQ ID NO: 12740 - RNA, 19 nt, Artificial Sequence
  Description of Artificial Sequence: Synthetic oligonucleotide
uucccagucgaggccaaag

SEQ ID NO: 12741 - RNA, 19 nt, Artificial Sequence
  Description of Artificial Sequence: Synthetic oligonucleotide
uaucccagucgaggccaaa

SEQ ID NO: 12742 - RNA, 19 nt, Artificial Sequence
  Description of Artificial Sequence: Synthetic oligonucleotide
ucaucccagucgaggccaa

SEQ ID NO: 12743 - RNA, 19 nt, Artificial Sequence
  Description of Artificial Sequence: Synthetic oligonucleotide
uccaucccagucgaggcca

SEQ ID NO: 12744 - RNA, 19 nt, Artificial Sequence
  Description of Artificial Sequence: Synthetic oligonucleotide
uaccaucccagucgaggcc

SEQ ID NO: 12745 - RNA, 19 nt, Artificial Sequence
  Description of Artificial Sequence: Synthetic oligonucleotide
ugaccaucccagucgaggc

SEQ ID NO: 12746 - RNA, 19 nt, Artificial Sequence
  Description of Artificial Sequence: Synthetic oligonucleotide
uagaccaucccagucgagg

SEQ ID NO: 12747 - RNA, 19 nt, Artificial Sequence
  Description of Artificial Sequence: Synthetic oligonucleotide
ugagaccaucccagucgag

SEQ ID NO: 12748 - RNA, 19 nt, Artificial Sequence
  Description of Artificial Sequence: Synthetic oligonucleotide
uggagaccaucccagucga

SEQ ID NO: 12749 - RNA, 19 nt, Artificial Sequence
  Description of Artificial Sequence: Synthetic oligonucleotide
ucggagaccaucccagucg

SEQ ID NO: 12750 - RNA, 19 nt, Artificial Sequence
  Description of Artificial Sequence: Synthetic oligonucleotide
uccggagaccaucccaguc

SEQ ID NO: 12751 - RNA, 19 nt, Artificial Sequence
  Description of Artificial Sequence: Synthetic oligonucleotide
ucccggagaccaucccagu

SEQ ID NO: 12752 - RNA, 19 nt, Artificial Sequence
  Description of Artificial Sequence: Synthetic oligonucleotide
uucccggagaccaucccag

SEQ ID NO: 12753 - RNA, 19 nt, Artificial Sequence
  Description of Artificial Sequence: Synthetic oligonucleotide
ugucccggagaccauccca

SEQ ID NO: 12754 - RNA, 19 nt, Artificial Sequence
  Description of Artificial Sequence: Synthetic oligonucleotide
uugucccggagaccauccc

SEQ ID NO: 12755 - RNA, 19 nt, Artificial Sequence
  Description of Artificial Sequence: Synthetic oligonucleotide
ucugucccggagaccaucc

SEQ ID NO: 12756 - RNA, 19 nt, Artificial Sequence
  Description of Artificial Sequence: Synthetic oligonucleotide
ugcugucccggagaccauc

SEQ ID NO: 12757 - RNA, 19 nt, Artificial Sequence
  Description of Artificial Sequence: Synthetic oligonucleotide
ucgcugucccggagaccau

SEQ ID NO: 12758 - RNA, 19 nt, Artificial Sequence
  Description of Artificial Sequence: Synthetic oligonucleotide
uacgcugucccggagacca

SEQ ID NO: 12759 - RNA, 19 nt, Artificial Sequence
  Description of Artificial Sequence: Synthetic oligonucleotide
ucacgcugucccggagacc

SEQ ID NO: 12760 - RNA, 19 nt, Artificial Sequence
  Description of Artificial Sequence: Synthetic oligonucleotide
ugcacgcugucccggagac

SEQ ID NO: 12761 - RNA, 19 nt, Artificial Sequence
  Description of Artificial Sequence: Synthetic oligonucleotide
uggcacgcugucccggaga

SEQ ID NO: 12762 - RNA, 19 nt, Artificial Sequence
  Description of Artificial Sequence: Synthetic oligonucleotide
ugggcacgcugucccggag

SEQ ID NO: 12763 - RNA, 19 nt, Artificial Sequence
  Description of Artificial Sequence: Synthetic oligonucleotide
uggggcacgcugucccgga

SEQ ID NO: 12764 - RNA, 19 nt, Artificial Sequence
  Description of Artificial Sequence: Synthetic oligonucleotide
ugggggcacgcugucccgg

SEQ ID NO: 12765 - RNA, 19 nt, Artificial Sequence
  Description of Artificial Sequence: Synthetic oligonucleotide
uggggggcacgcugucccg

SEQ ID NO: 12766 - RNA, 19 nt, Artificial Sequence
  Description of Artificial Sequence: Synthetic oligonucleotide
uaggggggcacgcuguccc

SEQ ID NO: 12767 - RNA, 19 nt, Artificial Sequence
  Description of Artificial Sequence: Synthetic oligonucleotide
uaaggggggcacgcugucc

SEQ ID NO: 12768 - RNA, 19 nt, Artificial Sequence
  Description of Artificial Sequence: Synthetic oligonucleotide
uaaaggggggcacgcuguc

SEQ ID NO: 12769 - RNA, 19 nt, Artificial Sequence
  Description of Artificial Sequence: Synthetic oligonucleotide
uuaaaggggggcacgcugu

SEQ ID NO: 12770 - RNA, 19 nt, Artificial Sequence
  Description of Artificial Sequence: Synthetic oligonucleotide
uguaaaggggggcacgcug

SEQ ID NO: 12771 - RNA, 19 nt, Artificial Sequence
  Description of Artificial Sequence: Synthetic oligonucleotide
uuguaaaggggggcacgcu

SEQ ID NO: 12772 - RNA, 19 nt, Artificial Sequence
  Description of Artificial Sequence: Synthetic oligonucleotide
uguguaaaggggggcacgc

SEQ ID NO: 12773 - RNA, 19 nt, Artificial Sequence
  Description of Artificial Sequence: Synthetic oligonucleotide
ugguguaaaggggggcacg

SEQ ID NO: 12774 - RNA, 19 nt, Artificial Sequence
  Description of Artificial Sequence: Synthetic oligonucleotide
ucgguguaaaggggggcac

SEQ ID NO: 12775 - RNA, 19 nt, Artificial Sequence
  Description of Artificial Sequence: Synthetic oligonucleotide
uccgguguaaaggggggca

SEQ ID NO: 12776 - RNA, 19 nt, Artificial Sequence
  Description of Artificial Sequence: Synthetic oligonucleotide
uuccgguguaaaggggggc

SEQ ID NO: 12777 - RNA, 19 nt, Artificial Sequence
  Description of Artificial Sequence: Synthetic oligonucleotide
uauccgguguaaagggggg

SEQ ID NO: 12778 - RNA, 19 nt, Artificial Sequence
  Description of Artificial Sequence: Synthetic oligonucleotide
uaauccgguguaaaggggg

SEQ ID NO: 12779 - RNA, 19 nt, Artificial Sequence
  Description of Artificial Sequence: Synthetic oligonucleotide
uaaauccgguguaaagggg

SEQ ID NO: 12780 - RNA, 19 nt, Artificial Sequence
  Description of Artificial Sequence: Synthetic oligonucleotide
ugaaauccgguguaaaggg

SEQ ID NO: 12781 - RNA, 19 nt, Artificial Sequence
  Description of Artificial Sequence: Synthetic oligonucleotide
ucgaaauccgguguaaagg

SEQ ID NO: 12782 - RNA, 19 nt, Artificial Sequence
  Description of Artificial Sequence: Synthetic oligonucleotide
uucgaaauccgguguaaag

SEQ ID NO: 12783 - RNA, 19 nt, Artificial Sequence
  Description of Artificial Sequence: Synthetic oligonucleotide
uuucgaaauccgguguaaa

SEQ ID NO: 12784 - RNA, 19 nt, Artificial Sequence
  Description of Artificial Sequence: Synthetic oligonucleotide
ucuucgaaauccgguguaa

SEQ ID NO: 12785 - RNA, 19 nt, Artificial Sequence
  Description of Artificial Sequence: Synthetic oligonucleotide
uccuucgaaauccggugua

SEQ ID NO: 12786 - RNA, 19 nt, Artificial Sequence
  Description of Artificial Sequence: Synthetic oligonucleotide
uaccuucgaaauccggugu

SEQ ID NO: 12787 - RNA, 19 nt, Artificial Sequence
  Description of Artificial Sequence: Synthetic oligonucleotide
ucaccuucgaaauccggug

SEQ ID NO: 12788 - RNA, 19 nt, Artificial Sequence
  Description of Artificial Sequence: Synthetic oligonucleotide
ugcaccuucgaaauccggu

SEQ ID NO: 12789 - RNA, 19 nt, Artificial Sequence
  Description of Artificial Sequence: Synthetic oligonucleotide
uggcaccuucgaaauccgg

SEQ ID NO: 12790 - RNA, 19 nt, Artificial Sequence
  Description of Artificial Sequence: Synthetic oligonucleotide
uuggcaccuucgaaauccg

SEQ ID NO: 12791 - RNA, 19 nt, Artificial Sequence
  Description of Artificial Sequence: Synthetic oligonucleotide
uguggcaccuucgaaaucc

SEQ ID NO: 12792 - RNA, 19 nt, Artificial Sequence
  Description of Artificial Sequence: Synthetic oligonucleotide
ugguggcaccuucgaaauc

SEQ ID NO: 12793 - RNA, 19 nt, Artificial Sequence
  Description of Artificial Sequence: Synthetic oligonucleotide
ucgguggcaccuucgaaau

SEQ ID NO: 12794 - RNA, 19 nt, Artificial Sequence
  Description of Artificial Sequence: Synthetic oligonucleotide
uucgguggcaccuucgaaa

SEQ ID NO: 12795 - RNA, 19 nt, Artificial Sequence
  Description of Artificial Sequence: Synthetic oligonucleotide
ugucgguggcaccuucgaa

SEQ ID NO: 12796 - RNA, 19 nt, Artificial Sequence
  Description of Artificial Sequence: Synthetic oligonucleotide
uugucgguggcaccuucga

SEQ ID NO: 12797 - RNA, 19 nt, Artificial Sequence
  Description of Artificial Sequence: Synthetic oligonucleotide
ugugucgguggcaccuucg

SEQ ID NO: 12798 - RNA, 19 nt, Artificial Sequence
  Description of Artificial Sequence: Synthetic oligonucleotide
uugugucgguggcaccuuc

SEQ ID NO: 12799 - RNA, 19 nt, Artificial Sequence
  Description of Artificial Sequence: Synthetic oligonucleotide
uaugugucgguggcaccuu

SEQ ID NO: 12800 - RNA, 19 nt, Artificial Sequence
  Description of Artificial Sequence: Synthetic oligonucleotide
ucaugugucgguggcaccu

SEQ ID NO: 12801 - RNA, 19 nt, Artificial Sequence
  Description of Artificial Sequence: Synthetic oligonucleotide
ugcaugugucgguggcacc

SEQ ID NO: 12802 - RNA, 19 nt, Artificial Sequence
  Description of Artificial Sequence: Synthetic oligonucleotide
uugcaugugucgguggcac

SEQ ID NO: 12803 - RNA, 19 nt, Artificial Sequence
  Description of Artificial Sequence: Synthetic oligonucleotide
uuugcaugugucgguggca

SEQ ID NO: 12804 - RNA, 19 nt, Artificial Sequence
  Description of Artificial Sequence: Synthetic oligonucleotide
uguugcaugugucgguggc

SEQ ID NO: 12805 - RNA, 19 nt, Artificial Sequence
  Description of Artificial Sequence: Synthetic oligonucleotide
uaguugcaugugucggugg

SEQ ID NO: 12806 - RNA, 19 nt, Artificial Sequence
  Description of Artificial Sequence: Synthetic oligonucleotide
uaaguugcaugugucggug

SEQ ID NO: 12807 - RNA, 19 nt, Artificial Sequence
  Description of Artificial Sequence: Synthetic oligonucleotide
ugaaguugcaugugucggu

SEQ ID NO: 12808 - RNA, 19 nt, Artificial Sequence
  Description of Artificial Sequence: Synthetic oligonucleotide
ucgaaguugcaugugucgg

SEQ ID NO: 12809 - RNA, 19 nt, Artificial Sequence
  Description of Artificial Sequence: Synthetic oligonucleotide
uucgaaguugcaugugucg

SEQ ID NO: 12810 - RNA, 19 nt, Artificial Sequence
  Description of Artificial Sequence: Synthetic oligonucleotide
ugucgaaguugcauguguc

SEQ ID NO: 12811 - RNA, 19 nt, Artificial Sequence
  Description of Artificial Sequence: Synthetic oligonucleotide
uagucgaaguugcaugugu

SEQ ID NO: 12812 - RNA, 19 nt, Artificial Sequence
  Description of Artificial Sequence: Synthetic oligonucleotide
uaagucgaaguugcaugug

SEQ ID NO: 12813 - RNA, 19 nt, Artificial Sequence
  Description of Artificial Sequence: Synthetic oligonucleotide
ucaagucgaaguugcaugu

SEQ ID NO: 12814 - RNA, 19 nt, Artificial Sequence
  Description of Artificial Sequence: Synthetic oligonucleotide
uccaagucgaaguugcaug

SEQ ID NO: 12815 - RNA, 19 nt, Artificial Sequence
  Description of Artificial Sequence: Synthetic oligonucleotide
uaccaagucgaaguugcau

SEQ ID NO: 12816 - RNA, 19 nt, Artificial Sequence
  Description of Artificial Sequence: Synthetic oligonucleotide
ucaccaagucgaaguugca

SEQ ID NO: 12817 - RNA, 19 nt, Artificial Sequence
  Description of Artificial Sequence: Synthetic oligonucleotide
uccaccaagucgaaguugc

SEQ ID NO: 12818 - RNA, 19 nt, Artificial Sequence
  Description of Artificial Sequence: Synthetic oligonucleotide
uuccaccaagucgaaguug

SEQ ID NO: 12819 - RNA, 19 nt, Artificial Sequence
  Description of Artificial Sequence: Synthetic oligonucleotide
ucuccaccaagucgaaguu

SEQ ID NO: 12820 - RNA, 19 nt, Artificial Sequence
  Description of Artificial Sequence: Synthetic oligonucleotide
uccuccaccaagucgaagu

SEQ ID NO: 12821 - RNA, 19 nt, Artificial Sequence
  Description of Artificial Sequence: Synthetic oligonucleotide
uuccuccaccaagucgaag

SEQ ID NO: 12822 - RNA, 19 nt, Artificial Sequence
  Description of Artificial Sequence: Synthetic oligonucleotide
uguccuccaccaagucgaa

SEQ ID NO: 12823 - RNA, 19 nt, Artificial Sequence
  Description of Artificial Sequence: Synthetic oligonucleotide
ucguccuccaccaagucga

SEQ ID NO: 12824 - RNA, 19 nt, Artificial Sequence
  Description of Artificial Sequence: Synthetic oligonucleotide
uccguccuccaccaagucg

SEQ ID NO: 12825 - RNA, 19 nt, Artificial Sequence
  Description of Artificial Sequence: Synthetic oligonucleotide
ucccguccuccaccaaguc

SEQ ID NO: 12826 - RNA, 19 nt, Artificial Sequence
  Description of Artificial Sequence: Synthetic oligonucleotide
ugcccguccuccaccaagu

SEQ ID NO: 12827 - RNA, 19 nt, Artificial Sequence
  Description of Artificial Sequence: Synthetic oligonucleotide
uagcccguccuccaccaag

SEQ ID NO: 12828 - RNA, 19 nt, Artificial Sequence
  Description of Artificial Sequence: Synthetic oligonucleotide
ugagcccguccuccaccaa

SEQ ID NO: 12829 - RNA, 19 nt, Artificial Sequence
  Description of Artificial Sequence: Synthetic oligonucleotide
uugagcccguccuccacca

SEQ ID NO: 12830 - RNA, 19 nt, Artificial Sequence
  Description of Artificial Sequence: Synthetic oligonucleotide
ugugagcccguccuccacc

SEQ ID NO: 12831 - RNA, 19 nt, Artificial Sequence
  Description of Artificial Sequence: Synthetic oligonucleotide
uagugagcccguccuccac

SEQ ID NO: 12832 - RNA, 19 nt, Artificial Sequence
  Description of Artificial Sequence: Synthetic oligonucleotide
ucagugagcccguccucca

SEQ ID NO: 12833 - RNA, 19 nt, Artificial Sequence
  Description of Artificial Sequence: Synthetic oligonucleotide
ugcagugagcccguccucc

SEQ ID NO: 12834 - RNA, 19 nt, Artificial Sequence
  Description of Artificial Sequence: Synthetic oligonucleotide
uggcagugagcccguccuc

SEQ ID NO: 12835 - RNA, 19 nt, Artificial Sequence
  Description of Artificial Sequence: Synthetic oligonucleotide
uuggcagugagcccguccu

SEQ ID NO: 12836 - RNA, 19 nt, Artificial Sequence
  Description of Artificial Sequence: Synthetic oligonucleotide
uauggcagugagcccgucc

SEQ ID NO: 12837 - RNA, 19 nt, Artificial Sequence
  Description of Artificial Sequence: Synthetic oligonucleotide
ucauggcagugagcccguc

SEQ ID NO: 12838 - RNA, 19 nt, Artificial Sequence
  Description of Artificial Sequence: Synthetic oligonucleotide
uccauggcagugagcccgu

SEQ ID NO: 12839 - RNA, 19 nt, Artificial Sequence
  Description of Artificial Sequence: Synthetic oligonucleotide
uuccauggcagugagcccg

SEQ ID NO: 12840 - RNA, 19 nt, Artificial Sequence
  Description of Artificial Sequence: Synthetic oligonucleotide
ucuccauggcagugagccc

SEQ ID NO: 12841 - RNA, 19 nt, Artificial Sequence
  Description of Artificial Sequence: Synthetic oligonucleotide
uucuccauggcagugagcc

SEQ ID NO: 12842 - RNA, 19 nt, Artificial Sequence
  Description of Artificial Sequence: Synthetic oligonucleotide
ugucuccauggcagugagc

SEQ ID NO: 12843 - RNA, 19 nt, Artificial Sequence
  Description of Artificial Sequence: Synthetic oligonucleotide
uugucuccauggcagugag

SEQ ID NO: 12844 - RNA, 19 nt, Artificial Sequence
  Description of Artificial Sequence: Synthetic oligonucleotide
ugugucuccauggcaguga

SEQ ID NO: 12845 - RNA, 19 nt, Artificial Sequence
  Description of Artificial Sequence: Synthetic oligonucleotide
uagugucuccauggcagug

SEQ ID NO: 12846 - RNA, 19 nt, Artificial Sequence
  Description of Artificial Sequence: Synthetic oligonucleotide
ucagugucuccauggcagu

SEQ ID NO: 12847 - RNA, 19 nt, Artificial Sequence
  Description of Artificial Sequence: Synthetic oligonucleotide
uacagugucuccauggcag

SEQ ID NO: 12848 - RNA, 19 nt, Artificial Sequence
  Description of Artificial Sequence: Synthetic oligonucleotide
ugacagugucuccauggca

SEQ ID NO: 12849 - RNA, 19 nt, Artificial Sequence
  Description of Artificial Sequence: Synthetic oligonucleotide
ucgacagugucuccauggc

SEQ ID NO: 12850 - RNA, 19 nt, Artificial Sequence
  Description of Artificial Sequence: Synthetic oligonucleotide
uccgacagugucuccaugg

SEQ ID NO: 12851 - RNA, 19 nt, Artificial Sequence
  Description of Artificial Sequence: Synthetic oligonucleotide
uuccgacagugucuccaug

SEQ ID NO: 12852 - RNA, 19 nt, Artificial Sequence
  Description of Artificial Sequence: Synthetic oligonucleotide
uguccgacagugucuccau

SEQ ID NO: 12853 - RNA, 19 nt, Artificial Sequence
  Description of Artificial Sequence: Synthetic oligonucleotide
uuguccgacagugucucca

SEQ ID NO: 12854 - RNA, 19 nt, Artificial Sequence
  Description of Artificial Sequence: Synthetic oligonucleotide
uauguccgacagugucucc

SEQ ID NO: 12855 - RNA, 19 nt, Artificial Sequence
  Description of Artificial Sequence: Synthetic oligonucleotide
uaauguccgacagugucuc

SEQ ID NO: 12856 - RNA, 19 nt, Artificial Sequence
  Description of Artificial Sequence: Synthetic oligonucleotide
ugaauguccgacagugucu

SEQ ID NO: 12857 - RNA, 19 nt, Artificial Sequence
  Description of Artificial Sequence: Synthetic oligonucleotide
ucgaauguccgacaguguc

SEQ ID NO: 12858 - RNA, 19 nt, Artificial Sequence
  Description of Artificial Sequence: Synthetic oligonucleotide
uccgaauguccgacagugu

SEQ ID NO: 12859 - RNA, 19 nt, Artificial Sequence
  Description of Artificial Sequence: Synthetic oligonucleotide
ucccgaauguccgacagug

SEQ ID NO: 12860 - RNA, 19 nt, Artificial Sequence
  Description of Artificial Sequence: Synthetic oligonucleotide
uucccgaauguccgacagu

SEQ ID NO: 12861 - RNA, 19 nt, Artificial Sequence
  Description of Artificial Sequence: Synthetic oligonucleotide
uuucccgaauguccgacag

SEQ ID NO: 12862 - RNA, 19 nt, Artificial Sequence
  Description of Artificial Sequence: Synthetic oligonucleotide
ucuucccgaauguccgaca

SEQ ID NO: 12863 - RNA, 19 nt, Artificial Sequence
  Description of Artificial Sequence: Synthetic oligonucleotide
uccuucccgaauguccgac

SEQ ID NO: 12864 - RNA, 19 nt, Artificial Sequence
  Description of Artificial Sequence: Synthetic oligonucleotide
uaccuucccgaauguccga

SEQ ID NO: 12865 - RNA, 19 nt, Artificial Sequence
  Description of Artificial Sequence: Synthetic oligonucleotide
ucaccuucccgaauguccg

SEQ ID NO: 12866 - RNA, 19 nt, Artificial Sequence
  Description of Artificial Sequence: Synthetic oligonucleotide
ugcaccuucccgaaugucc

SEQ ID NO: 12867 - RNA, 19 nt, Artificial Sequence
  Description of Artificial Sequence: Synthetic oligonucleotide
ucgcaccuucccgaauguc

SEQ ID NO: 12868 - RNA, 19 nt, Artificial Sequence
  Description of Artificial Sequence: Synthetic oligonucleotide
ugcgcaccuucccgaaugu

SEQ ID NO: 12869 - RNA, 19 nt, Artificial Sequence
  Description of Artificial Sequence: Synthetic oligonucleotide
uggcgcaccuucccgaaug

SEQ ID NO: 12870 - RNA, 19 nt, Artificial Sequence
  Description of Artificial Sequence: Synthetic oligonucleotide
ucggcgcaccuucccgaau

SEQ ID NO: 12871 - RNA, 19 nt, Artificial Sequence
  Description of Artificial Sequence: Synthetic oligonucleotide
ugcggcgcaccuucccgaa

SEQ ID NO: 12872 - RNA, 19 nt, Artificial Sequence
  Description of Artificial Sequence: Synthetic oligonucleotide
uagcggcgcaccuucccga

SEQ ID NO: 12873 - RNA, 19 nt, Artificial Sequence
  Description of Artificial Sequence: Synthetic oligonucleotide
uuagcggcgcaccuucccg

SEQ ID NO: 12874 - RNA, 19 nt, Artificial Sequence
  Description of Artificial Sequence: Synthetic oligonucleotide
ucuagcggcgcaccuuccc

SEQ ID NO: 12875 - RNA, 19 nt, Artificial Sequence
  Description of Artificial Sequence: Synthetic oligonucleotide
uccuagcggcgcaccuucc

SEQ ID NO: 12876 - RNA, 19 nt, Artificial Sequence
  Description of Artificial Sequence: Synthetic oligonucleotide
ucccuagcggcgcaccuuc

SEQ ID NO: 12877 - RNA, 19 nt, Artificial Sequence
  Description of Artificial Sequence: Synthetic oligonucleotide
uccccuagcggcgcaccuu

SEQ ID NO: 12878 - RNA, 19 nt, Artificial Sequence
  Description of Artificial Sequence: Synthetic oligonucleotide
uaccccuagcggcgcaccu

SEQ ID NO: 12879 - RNA, 19 nt, Artificial Sequence
  Description of Artificial Sequence: Synthetic oligonucleotide
ugaccccuagcggcgcacc

SEQ ID NO: 12880 - RNA, 19 nt, Artificial Sequence
  Description of Artificial Sequence: Synthetic oligonucleotide
uggaccccuagcggcgcac

SEQ ID NO: 12881 - RNA, 19 nt, Artificial Sequence
  Description of Artificial Sequence: Synthetic oligonucleotide
uuggaccccuagcggcgca

SEQ ID NO: 12882 - RNA, 19 nt, Artificial Sequence
  Description of Artificial Sequence: Synthetic oligonucleotide
uguggaccccuagcggcgc

SEQ ID NO: 12883 - RNA, 19 nt, Artificial Sequence
  Description of Artificial Sequence: Synthetic oligonucleotide
ugguggaccccuagcggcg

SEQ ID NO: 12884 - RNA, 19 nt, Artificial Sequence
  Description of Artificial Sequence: Synthetic oligonucleotide
uagguggaccccuagcggc

SEQ ID NO: 12885 - RNA, 19 nt, Artificial Sequence
  Description of Artificial Sequence: Synthetic oligonucleotide
ucagguggaccccuagcgg

SEQ ID NO: 12886 - RNA, 19 nt, Artificial Sequence
  Description of Artificial Sequence: Synthetic oligonucleotide
ugcagguggaccccuagcg

SEQ ID NO: 12887 - RNA, 19 nt, Artificial Sequence
  Description of Artificial Sequence: Synthetic oligonucleotide
uggcagguggaccccuagc

SEQ ID NO: 12888 - RNA, 19 nt, Artificial Sequence
  Description of Artificial Sequence: Synthetic oligonucleotide
uaggcagguggaccccuag

SEQ ID NO: 12889 - RNA, 19 nt, Artificial Sequence
  Description of Artificial Sequence: Synthetic oligonucleotide
uaaggcagguggaccccua

SEQ ID NO: 12890 - RNA, 19 nt, Artificial Sequence
  Description of Artificial Sequence: Synthetic oligonucleotide
uaaaggcagguggaccccu

SEQ ID NO: 12891 - RNA, 19 nt, Artificial Sequence
  Description of Artificial Sequence: Synthetic oligonucleotide
uaaaaggcagguggacccc

SEQ ID NO: 12892 - RNA, 19 nt, Artificial Sequence
  Description of Artificial Sequence: Synthetic oligonucleotide
ucaaaaggcagguggaccc

SEQ ID NO: 12893 - RNA, 19 nt, Artificial Sequence
  Description of Artificial Sequence: Synthetic oligonucleotide
uacaaaaggcagguggacc

SEQ ID NO: 12894 - RNA, 19 nt, Artificial Sequence
  Description of Artificial Sequence: Synthetic oligonucleotide
ucacaaaaggcagguggac

SEQ ID NO: 12895 - RNA, 19 nt, Artificial Sequence
  Description of Artificial Sequence: Synthetic oligonucleotide
uccacaaaaggcaggugga

SEQ ID NO: 12896 - RNA, 19 nt, Artificial Sequence
  Description of Artificial Sequence: Synthetic oligonucleotide
ucccacaaaaggcaggugg

SEQ ID NO: 12897 - RNA, 19 nt, Artificial Sequence
  Description of Artificial Sequence: Synthetic oligonucleotide
ugcccacaaaaggcaggug

SEQ ID NO: 12898 - RNA, 19 nt, Artificial Sequence
  Description of Artificial Sequence: Synthetic oligonucleotide
uagcccacaaaaggcaggu

SEQ ID NO: 12899 - RNA, 19 nt, Artificial Sequence
  Description of Artificial Sequence: Synthetic oligonucleotide
uuagcccacaaaaggcagg

SEQ ID NO: 12900 - RNA, 19 nt, Artificial Sequence
  Description of Artificial Sequence: Synthetic oligonucleotide
uguagcccacaaaaggcag

SEQ ID NO: 12901 - RNA, 19 nt, Artificial Sequence
  Description of Artificial Sequence: Synthetic oligonucleotide
uaguagcccacaaaaggca

SEQ ID NO: 12902 - RNA, 19 nt, Artificial Sequence
  Description of Artificial Sequence: Synthetic oligonucleotide
ugaguagcccacaaaaggc

SEQ ID NO: 12903 - RNA, 19 nt, Artificial Sequence
  Description of Artificial Sequence: Synthetic oligonucleotide
uggaguagcccacaaaagg

SEQ ID NO: 12904 - RNA, 19 nt, Artificial Sequence
  Description of Artificial Sequence: Synthetic oligonucleotide
uaggaguagcccacaaaag

SEQ ID NO: 12905 - RNA, 19 nt, Artificial Sequence
  Description of Artificial Sequence: Synthetic oligonucleotide
uuaggaguagcccacaaaa

SEQ ID NO: 12906 - RNA, 19 nt, Artificial Sequence
  Description of Artificial Sequence: Synthetic oligonucleotide
uguaggaguagcccacaaa

SEQ ID NO: 12907 - RNA, 19 nt, Artificial Sequence
  Description of Artificial Sequence: Synthetic oligonucleotide
uaguaggaguagcccacaa

SEQ ID NO: 12908 - RNA, 19 nt, Artificial Sequence
  Description of Artificial Sequence: Synthetic oligonucleotide
ugaguaggaguagcccaca

SEQ ID NO: 12909 - RNA, 19 nt, Artificial Sequence
  Description of Artificial Sequence: Synthetic oligonucleotide
uggaguaggaguagcccac

SEQ ID NO: 12910 - RNA, 19 nt, Artificial Sequence
  Description of Artificial Sequence: Synthetic oligonucleotide
uaggaguaggaguagccca

SEQ ID NO: 12911 - RNA, 19 nt, Artificial Sequence
  Description of Artificial Sequence: Synthetic oligonucleotide
ucaggaguaggaguagccc

SEQ ID NO: 12912 - RNA, 19 nt, Artificial Sequence
  Description of Artificial Sequence: Synthetic oligonucleotide
ugcaggaguaggaguagcc

SEQ ID NO: 12913 - RNA, 19 nt, Artificial Sequence
  Description of Artificial Sequence: Synthetic oligonucleotide
uugcaggaguaggaguagc

SEQ ID NO: 12914 - RNA, 19 nt, Artificial Sequence
  Description of Artificial Sequence: Synthetic oligonucleotide
uaugcaggaguaggaguag

SEQ ID NO: 12915 - RNA, 19 nt, Artificial Sequence
  Description of Artificial Sequence: Synthetic oligonucleotide
ucaugcaggaguaggagua

SEQ ID NO: 12916 - RNA, 19 nt, Artificial Sequence
  Description of Artificial Sequence: Synthetic oligonucleotide
uccaugcaggaguaggagu

SEQ ID NO: 12917 - RNA, 19 nt, Artificial Sequence
  Description of Artificial Sequence: Synthetic oligonucleotide
ugccaugcaggaguaggag

SEQ ID NO: 12918 - RNA, 19 nt, Artificial Sequence
  Description of Artificial Sequence: Synthetic oligonucleotide
uggccaugcaggaguagga

SEQ ID NO: 12919 - RNA, 19 nt, Artificial Sequence
  Description of Artificial Sequence: Synthetic oligonucleotide
ugggccaugcaggaguagg

SEQ ID NO: 12920 - RNA, 19 nt, Artificial Sequence
  Description of Artificial Sequence: Synthetic oligonucleotide
uagggccaugcaggaguag

SEQ ID NO: 12921 - RNA, 19 nt, Artificial Sequence
  Description of Artificial Sequence: Synthetic oligonucleotide
ugagggccaugcaggagua

SEQ ID NO: 12922 - RNA, 19 nt, Artificial Sequence
  Description of Artificial Sequence: Synthetic oligonucleotide
uugagggccaugcaggagu

SEQ ID NO: 12923 - RNA, 19 nt, Artificial Sequence
  Description of Artificial Sequence: Synthetic oligonucleotide
ucugagggccaugcaggag

SEQ ID NO: 12924 - RNA, 19 nt, Artificial Sequence
  Description of Artificial Sequence: Synthetic oligonucleotide
uccugagggccaugcagga

SEQ ID NO: 12925 - RNA, 19 nt, Artificial Sequence
  Description of Artificial Sequence: Synthetic oligonucleotide
ucccugagggccaugcagg

SEQ ID NO: 12926 - RNA, 19 nt, Artificial Sequence
  Description of Artificial Sequence: Synthetic oligonucleotide
uucccugagggccaugcag

SEQ ID NO: 12927 - RNA, 19 nt, Artificial Sequence
  Description of Artificial Sequence: Synthetic oligonucleotide
ugucccugagggccaugca

SEQ ID NO: 12928 - RNA, 19 nt, Artificial Sequence
  Description of Artificial Sequence: Synthetic oligonucleotide
uugucccugagggccaugc

SEQ ID NO: 12929 - RNA, 19 nt, Artificial Sequence
  Description of Artificial Sequence: Synthetic oligonucleotide
ucugucccugagggccaug

SEQ ID NO: 12930 - RNA, 19 nt, Artificial Sequence
  Description of Artificial Sequence: Synthetic oligonucleotide
uacugucccugagggccau

SEQ ID NO: 12931 - RNA, 19 nt, Artificial Sequence
  Description of Artificial Sequence: Synthetic oligonucleotide
ucacugucccugagggcca

SEQ ID NO: 12932 - RNA, 19 nt, Artificial Sequence
  Description of Artificial Sequence: Synthetic oligonucleotide
uucacugucccugagggcc

SEQ ID NO: 12933 - RNA, 19 nt, Artificial Sequence
  Description of Artificial Sequence: Synthetic oligonucleotide
ucucacugucccugagggc

SEQ ID NO: 12934 - RNA, 19 nt, Artificial Sequence
  Description of Artificial Sequence: Synthetic oligonucleotide
uccucacugucccugaggg

SEQ ID NO: 12935 - RNA, 19 nt, Artificial Sequence
  Description of Artificial Sequence: Synthetic oligonucleotide
uaccucacugucccugagg

SEQ ID NO: 12936 - RNA, 19 nt, Artificial Sequence
  Description of Artificial Sequence: Synthetic oligonucleotide
ugaccucacugucccugag

SEQ ID NO: 12937 - RNA, 19 nt, Artificial Sequence
  Description of Artificial Sequence: Synthetic oligonucleotide
uggaccucacugucccuga

SEQ ID NO: 12938 - RNA, 19 nt, Artificial Sequence
  Description of Artificial Sequence: Synthetic oligonucleotide
ugggaccucacugucccug

SEQ ID NO: 12939 - RNA, 19 nt, Artificial Sequence
  Description of Artificial Sequence: Synthetic oligonucleotide
uugggaccucacugucccu

SEQ ID NO: 12940 - RNA, 19 nt, Artificial Sequence
  Description of Artificial Sequence: Synthetic oligonucleotide
ucugggaccucacuguccc

SEQ ID NO: 12941 - RNA, 19 nt, Artificial Sequence
  Description of Artificial Sequence: Synthetic oligonucleotide
uccugggaccucacugucc

SEQ ID NO: 12942 - RNA, 19 nt, Artificial Sequence
  Description of Artificial Sequence: Synthetic oligonucleotide
ugccugggaccucacuguc

SEQ ID NO: 12943 - RNA, 19 nt, Artificial Sequence
  Description of Artificial Sequence: Synthetic oligonucleotide
uggccugggaccucacugu

SEQ ID NO: 12944 - RNA, 19 nt, Artificial Sequence
  Description of Artificial Sequence: Synthetic oligonucleotide
ugggccugggaccucacug

SEQ ID NO: 12945 - RNA, 19 nt, Artificial Sequence
  Description of Artificial Sequence: Synthetic oligonucleotide
uggggccugggaccucacu

SEQ ID NO: 12946 - RNA, 19 nt, Artificial Sequence
  Description of Artificial Sequence: Synthetic oligonucleotide
uuggggccugggaccucac

SEQ ID NO: 12947 - RNA, 19 nt, Artificial Sequence
  Description of Artificial Sequence: Synthetic oligonucleotide
uguggggccugggaccuca

SEQ ID NO: 12948 - RNA, 19 nt, Artificial Sequence
  Description of Artificial Sequence: Synthetic oligonucleotide
uuguggggccugggaccuc

SEQ ID NO: 12949 - RNA, 19 nt, Artificial Sequence
  Description of Artificial Sequence: Synthetic oligonucleotide
uguguggggccugggaccu

SEQ ID NO: 12950 - RNA, 19 nt, Artificial Sequence
  Description of Artificial Sequence: Synthetic oligonucleotide
ugguguggggccugggacc

SEQ ID NO: 12951 - RNA, 19 nt, Artificial Sequence
  Description of Artificial Sequence: Synthetic oligonucleotide
uggguguggggccugggac

SEQ ID NO: 12952 - RNA, 19 nt, Artificial Sequence
  Description of Artificial Sequence: Synthetic oligonucleotide
uuggguguggggccuggga

SEQ ID NO: 12953 - RNA, 19 nt, Artificial Sequence
  Description of Artificial Sequence: Synthetic oligonucleotide
uauggguguggggccuggg

SEQ ID NO: 12954 - RNA, 19 nt, Artificial Sequence
  Description of Artificial Sequence: Synthetic oligonucleotide
ucauggguguggggccugg

SEQ ID NO: 12955 - RNA, 19 nt, Artificial Sequence
  Description of Artificial Sequence: Synthetic oligonucleotide
uccauggguguggggccug

SEQ ID NO: 12956 - RNA, 19 nt, Artificial Sequence
  Description of Artificial Sequence: Synthetic oligonucleotide
uuccauggguguggggccu

SEQ ID NO: 12957 - RNA, 19 nt, Artificial Sequence
  Description of Artificial Sequence: Synthetic oligonucleotide
uuuccauggguguggggcc

SEQ ID NO: 12958 - RNA, 19 nt, Artificial Sequence
  Description of Artificial Sequence: Synthetic oligonucleotide
uguuccauggguguggggc

SEQ ID NO: 12959 - RNA, 19 nt, Artificial Sequence
  Description of Artificial Sequence: Synthetic oligonucleotide
uaguuccaugggugugggg

SEQ ID NO: 12960 - RNA, 19 nt, Artificial Sequence
  Description of Artificial Sequence: Synthetic oligonucleotide
ucaguuccauggguguggg

SEQ ID NO: 12961 - RNA, 19 nt, Artificial Sequence
  Description of Artificial Sequence: Synthetic oligonucleotide
uccaguuccaugggugugg

SEQ ID NO: 12962 - RNA, 19 nt, Artificial Sequence
  Description of Artificial Sequence: Synthetic oligonucleotide
uuccaguuccaugggugug

SEQ ID NO: 12963 - RNA, 19 nt, Artificial Sequence
  Description of Artificial Sequence: Synthetic oligonucleotide
ucuccaguuccaugggugu

SEQ ID NO: 12964 - RNA, 19 nt, Artificial Sequence
  Description of Artificial Sequence: Synthetic oligonucleotide
uccuccaguuccaugggug

SEQ ID NO: 12965 - RNA, 19 nt, Artificial Sequence
  Description of Artificial Sequence: Synthetic oligonucleotide
ugccuccaguuccaugggu

SEQ ID NO: 12966 - RNA, 19 nt, Artificial Sequence
  Description of Artificial Sequence: Synthetic oligonucleotide
uggccuccaguuccauggg

SEQ ID NO: 12967 - RNA, 19 nt, Artificial Sequence
  Description of Artificial Sequence: Synthetic oligonucleotide
ucggccuccaguuccaugg

SEQ ID NO: 12968 - RNA, 19 nt, Artificial Sequence
  Description of Artificial Sequence: Synthetic oligonucleotide
uucggccuccaguuccaug

SEQ ID NO: 12969 - RNA, 19 nt, Artificial Sequence
  Description of Artificial Sequence: Synthetic oligonucleotide
ucucggccuccaguuccau

SEQ ID NO: 12970 - RNA, 19 nt, Artificial Sequence
  Description of Artificial Sequence: Synthetic oligonucleotide
ugcucggccuccaguucca

SEQ ID NO: 12971 - RNA, 19 nt, Artificial Sequence
  Description of Artificial Sequence: Synthetic oligonucleotide
uugcucggccuccaguucc

SEQ ID NO: 12972 - RNA, 19 nt, Artificial Sequence
  Description of Artificial Sequence: Synthetic oligonucleotide
ucugcucggccuccaguuc

SEQ ID NO: 12973 - RNA, 19 nt, Artificial Sequence
  Description of Artificial Sequence: Synthetic oligonucleotide
ugcugcucggccuccaguu

SEQ ID NO: 12974 - RNA, 19 nt, Artificial Sequence
  Description of Artificial Sequence: Synthetic oligonucleotide
uagcugcucggccuccagu

SEQ ID NO: 12975 - RNA, 19 nt, Artificial Sequence
  Description of Artificial Sequence: Synthetic oligonucleotide
ucagcugcucggccuccag

SEQ ID NO: 12976 - RNA, 19 nt, Artificial Sequence
  Description of Artificial Sequence: Synthetic oligonucleotide
ugcagcugcucggccucca

SEQ ID NO: 12977 - RNA, 19 nt, Artificial Sequence
  Description of Artificial Sequence: Synthetic oligonucleotide
uagcagcugcucggccucc

SEQ ID NO: 12978 - RNA, 19 nt, Artificial Sequence
  Description of Artificial Sequence: Synthetic oligonucleotide
uaagcagcugcucggccuc

SEQ ID NO: 12979 - RNA, 19 nt, Artificial Sequence
  Description of Artificial Sequence: Synthetic oligonucleotide
ucaagcagcugcucggccu

SEQ ID NO: 12980 - RNA, 19 nt, Artificial Sequence
  Description of Artificial Sequence: Synthetic oligonucleotide
uucaagcagcugcucggcc

SEQ ID NO: 12981 - RNA, 19 nt, Artificial Sequence
  Description of Artificial Sequence: Synthetic oligonucleotide
ucucaagcagcugcucggc

SEQ ID NO: 12982 - RNA, 19 nt, Artificial Sequence
  Description of Artificial Sequence: Synthetic oligonucleotide
ugcucaagcagcugcucgg

SEQ ID NO: 12983 - RNA, 19 nt, Artificial Sequence
  Description of Artificial Sequence: Synthetic oligonucleotide
uggcucaagcagcugcucg

SEQ ID NO: 12984 - RNA, 19 nt, Artificial Sequence
  Description of Artificial Sequence: Synthetic oligonucleotide
uuggcucaagcagcugcuc

SEQ ID NO: 12985 - RNA, 19 nt, Artificial Sequence
  Description of Artificial Sequence: Synthetic oligonucleotide
uguggcucaagcagcugcu

SEQ ID NO: 12986 - RNA, 19 nt, Artificial Sequence
  Description of Artificial Sequence: Synthetic oligonucleotide
uuguggcucaagcagcugc

SEQ ID NO: 12987 - RNA, 19 nt, Artificial Sequence
  Description of Artificial Sequence: Synthetic oligonucleotide
uguguggcucaagcagcug

SEQ ID NO: 12988 - RNA, 19 nt, Artificial Sequence
  Description of Artificial Sequence: Synthetic oligonucleotide
ucguguggcucaagcagcu

SEQ ID NO: 12989 - RNA, 19 nt, Artificial Sequence
  Description of Artificial Sequence: Synthetic oligonucleotide
uacguguggcucaagcagc

SEQ ID NO: 12990 - RNA, 19 nt, Artificial Sequence
  Description of Artificial Sequence: Synthetic oligonucleotide
ucacguguggcucaagcag

SEQ ID NO: 12991 - RNA, 19 nt, Artificial Sequence
  Description of Artificial Sequence: Synthetic oligonucleotide
ugcacguguggcucaagca

SEQ ID NO: 12992 - RNA, 19 nt, Artificial Sequence
  Description of Artificial Sequence: Synthetic oligonucleotide
uugcacguguggcucaagc

SEQ ID NO: 12993 - RNA, 19 nt, Artificial Sequence
  Description of Artificial Sequence: Synthetic oligonucleotide
uuugcacguguggcucaag

SEQ ID NO: 12994 - RNA, 19 nt, Artificial Sequence
  Description of Artificial Sequence: Synthetic oligonucleotide
ucuugcacguguggcucaa

SEQ ID NO: 12995 - RNA, 19 nt, Artificial Sequence
  Description of Artificial Sequence: Synthetic oligonucleotide
ugcuugcacguguggcuca

SEQ ID NO: 12996 - RNA, 19 nt, Artificial Sequence
  Description of Artificial Sequence: Synthetic oligonucleotide
ucgcuugcacguguggcuc

SEQ ID NO: 12997 - RNA, 19 nt, Artificial Sequence
  Description of Artificial Sequence: Synthetic oligonucleotide
ugcgcuugcacguguggcu

SEQ ID NO: 12998 - RNA, 19 nt, Artificial Sequence
  Description of Artificial Sequence: Synthetic oligonucleotide
uggcgcuugcacguguggc

SEQ ID NO: 12999 - RNA, 19 nt, Artificial Sequence
  Description of Artificial Sequence: Synthetic oligonucleotide
ugggcgcuugcacgugugg

SEQ ID NO: 13000 - RNA, 19 nt, Artificial Sequence
  Description of Artificial Sequence: Synthetic oligonucleotide
uugggcgcuugcacgugug

SEQ ID NO: 13001 - RNA, 19 nt, Artificial Sequence
  Description of Artificial Sequence: Synthetic oligonucleotide
ucugggcgcuugcacgugu

SEQ ID NO: 13002 - RNA, 19 nt, Artificial Sequence
  Description of Artificial Sequence: Synthetic oligonucleotide
ugcugggcgcuugcacgug

SEQ ID NO: 13003 - RNA, 19 nt, Artificial Sequence
  Description of Artificial Sequence: Synthetic oligonucleotide
uggcugggcgcuugcacgu

SEQ ID NO: 13004 - RNA, 19 nt, Artificial Sequence
  Description of Artificial Sequence: Synthetic oligonucleotide
uaggcugggcgcuugcacg

SEQ ID NO: 13005 - RNA, 19 nt, Artificial Sequence
  Description of Artificial Sequence: Synthetic oligonucleotide
ucaggcugggcgcuugcac

SEQ ID NO: 13006 - RNA, 19 nt, Artificial Sequence
  Description of Artificial Sequence: Synthetic oligonucleotide
uccaggcugggcgcuugca

SEQ ID NO: 13007 - RNA, 19 nt, Artificial Sequence
  Description of Artificial Sequence: Synthetic oligonucleotide
uuccaggcugggcgcuugc

SEQ ID NO: 13008 - RNA, 19 nt, Artificial Sequence
  Description of Artificial Sequence: Synthetic oligonucleotide
ucuccaggcugggcgcuug

SEQ ID NO: 13009 - RNA, 19 nt, Artificial Sequence
  Description of Artificial Sequence: Synthetic oligonucleotide
ugcuccaggcugggcgcuu

SEQ ID NO: 13010 - RNA, 19 nt, Artificial Sequence
  Description of Artificial Sequence: Synthetic oligonucleotide
uggcuccaggcugggcgcu

SEQ ID NO: 13011 - RNA, 19 nt, Artificial Sequence
  Description of Artificial Sequence: Synthetic oligonucleotide
ugggcuccaggcugggcgc

SEQ ID NO: 13012 - RNA, 19 nt, Artificial Sequence
  Description of Artificial Sequence: Synthetic oligonucleotide
uagggcuccaggcugggcg

SEQ ID NO: 13013 - RNA, 19 nt, Artificial Sequence
  Description of Artificial Sequence: Synthetic oligonucleotide
ugagggcuccaggcugggc

SEQ ID NO: 13014 - RNA, 19 nt, Artificial Sequence
  Description of Artificial Sequence: Synthetic oligonucleotide
ucgagggcuccaggcuggg

SEQ ID NO: 13015 - RNA, 19 nt, Artificial Sequence
  Description of Artificial Sequence: Synthetic oligonucleotide
uccgagggcuccaggcugg

SEQ ID NO: 13016 - RNA, 19 nt, Artificial Sequence
  Description of Artificial Sequence: Synthetic oligonucleotide
uaccgagggcuccaggcug

SEQ ID NO: 13017 - RNA, 19 nt, Artificial Sequence
  Description of Artificial Sequence: Synthetic oligonucleotide
ucaccgagggcuccaggcu

SEQ ID NO: 13018 - RNA, 19 nt, Artificial Sequence
  Description of Artificial Sequence: Synthetic oligonucleotide
uacaccgagggcuccaggc

SEQ ID NO: 13019 - RNA, 19 nt, Artificial Sequence
  Description of Artificial Sequence: Synthetic oligonucleotide
ugacaccgagggcuccagg

SEQ ID NO: 13020 - RNA, 19 nt, Artificial Sequence
  Description of Artificial Sequence: Synthetic oligonucleotide
uggacaccgagggcuccag

SEQ ID NO: 13021 - RNA, 19 nt, Artificial Sequence
  Description of Artificial Sequence: Synthetic oligonucleotide
ugggacaccgagggcucca

SEQ ID NO: 13022 - RNA, 19 nt, Artificial Sequence
  Description of Artificial Sequence: Synthetic oligonucleotide
uggggacaccgagggcucc

SEQ ID NO: 13023 - RNA, 19 nt, Artificial Sequence
  Description of Artificial Sequence: Synthetic oligonucleotide
uuggggacaccgagggcuc

SEQ ID NO: 13024 - RNA, 19 nt, Artificial Sequence
  Description of Artificial Sequence: Synthetic oligonucleotide
uguggggacaccgagggcu

SEQ ID NO: 13025 - RNA, 19 nt, Artificial Sequence
  Description of Artificial Sequence: Synthetic oligonucleotide
uuguggggacaccgagggc

SEQ ID NO: 13026 - RNA, 19 nt, Artificial Sequence
  Description of Artificial Sequence: Synthetic oligonucleotide
ucuguggggacaccgaggg

SEQ ID NO: 13027 - RNA, 19 nt, Artificial Sequence
  Description of Artificial Sequence: Synthetic oligonucleotide
uccuguggggacaccgagg

SEQ ID NO: 13028 - RNA, 19 nt, Artificial Sequence
  Description of Artificial Sequence: Synthetic oligonucleotide
uuccuguggggacaccgag

SEQ ID NO: 13029 - RNA, 19 nt, Artificial Sequence
  Description of Artificial Sequence: Synthetic oligonucleotide
uauccuguggggacaccga

SEQ ID NO: 13030 - RNA, 19 nt, Artificial Sequence
  Description of Artificial Sequence: Synthetic oligonucleotide
ucauccuguggggacaccg

SEQ ID NO: 13031 - RNA, 19 nt, Artificial Sequence
  Description of Artificial Sequence: Synthetic oligonucleotide
uucauccuguggggacacc

SEQ ID NO: 13032 - RNA, 19 nt, Artificial Sequence
  Description of Artificial Sequence: Synthetic oligonucleotide
uuucauccuguggggacac

SEQ ID NO: 13033 - RNA, 19 nt, Artificial Sequence
  Description of Artificial Sequence: Synthetic oligonucleotide
uuuucauccuguggggaca

SEQ ID NO: 13034 - RNA, 19 nt, Artificial Sequence
  Description of Artificial Sequence: Synthetic oligonucleotide
uguuucauccuguggggac

SEQ ID NO: 13035 - RNA, 19 nt, Artificial Sequence
  Description of Artificial Sequence: Synthetic oligonucleotide
uuguuucauccugugggga

SEQ ID NO: 13036 - RNA, 19 nt, Artificial Sequence
  Description of Artificial Sequence: Synthetic oligonucleotide
ucuguuucauccugugggg

SEQ ID NO: 13037 - RNA, 19 nt, Artificial Sequence
  Description of Artificial Sequence: Synthetic oligonucleotide
ugcuguuucauccuguggg

SEQ ID NO: 13038 - RNA, 19 nt, Artificial Sequence
  Description of Artificial Sequence: Synthetic oligonucleotide
uagcuguuucauccugugg

SEQ ID NO: 13039 - RNA, 19 nt, Artificial Sequence
  Description of Artificial Sequence: Synthetic oligonucleotide
ucagcuguuucauccugug

SEQ ID NO: 13040 - RNA, 19 nt, Artificial Sequence
  Description of Artificial Sequence: Synthetic oligonucleotide
uucagcuguuucauccugu

SEQ ID NO: 13041 - RNA, 19 nt, Artificial Sequence
  Description of Artificial Sequence: Synthetic oligonucleotide
uuucagcuguuucauccug

SEQ ID NO: 13042 - RNA, 19 nt, Artificial Sequence
  Description of Artificial Sequence: Synthetic oligonucleotide
ucuucagcuguuucauccu

SEQ ID NO: 13043 - RNA, 19 nt, Artificial Sequence
  Description of Artificial Sequence: Synthetic oligonucleotide
uacuucagcuguuucaucc

SEQ ID NO: 13044 - RNA, 19 nt, Artificial Sequence
  Description of Artificial Sequence: Synthetic oligonucleotide
ucacuucagcuguuucauc

SEQ ID NO: 13045 - RNA, 19 nt, Artificial Sequence
  Description of Artificial Sequence: Synthetic oligonucleotide
uccacuucagcuguuucau

SEQ ID NO: 13046 - RNA, 19 nt, Artificial Sequence
  Description of Artificial Sequence: Synthetic oligonucleotide
ugccacuucagcuguuuca

SEQ ID NO: 13047 - RNA, 19 nt, Artificial Sequence
  Description of Artificial Sequence: Synthetic oligonucleotide
uugccacuucagcuguuuc

SEQ ID NO: 13048 - RNA, 19 nt, Artificial Sequence
  Description of Artificial Sequence: Synthetic oligonucleotide
ucugccacuucagcuguuu

SEQ ID NO: 13049 - RNA, 19 nt, Artificial Sequence
  Description of Artificial Sequence: Synthetic oligonucleotide
uacugccacuucagcuguu

SEQ ID NO: 13050 - RNA, 19 nt, Artificial Sequence
  Description of Artificial Sequence: Synthetic oligonucleotide
uaacugccacuucagcugu

SEQ ID NO: 13051 - RNA, 19 nt, Artificial Sequence
  Description of Artificial Sequence: Synthetic oligonucleotide
ugaacugccacuucagcug

SEQ ID NO: 13052 - RNA, 19 nt, Artificial Sequence
  Description of Artificial Sequence: Synthetic oligonucleotide
uggaacugccacuucagcu

SEQ ID NO: 13053 - RNA, 19 nt, Artificial Sequence
  Description of Artificial Sequence: Synthetic oligonucleotide
uuggaacugccacuucagc

SEQ ID NO: 13054 - RNA, 19 nt, Artificial Sequence
  Description of Artificial Sequence: Synthetic oligonucleotide
ucuggaacugccacuucag

SEQ ID NO: 13055 - RNA, 19 nt, Artificial Sequence
  Description of Artificial Sequence: Synthetic oligonucleotide
ugcuggaacugccacuuca

SEQ ID NO: 13056 - RNA, 19 nt, Artificial Sequence
  Description of Artificial Sequence: Synthetic oligonucleotide
ucgcuggaacugccacuuc

SEQ ID NO: 13057 - RNA, 19 nt, Artificial Sequence
  Description of Artificial Sequence: Synthetic oligonucleotide
uccgcuggaacugccacuu

SEQ ID NO: 13058 - RNA, 19 nt, Artificial Sequence
  Description of Artificial Sequence: Synthetic oligonucleotide
ugccgcuggaacugccacu

SEQ ID NO: 13059 - RNA, 19 nt, Artificial Sequence
  Description of Artificial Sequence: Synthetic oligonucleotide
uagccgcuggaacugccac

SEQ ID NO: 13060 - RNA, 19 nt, Artificial Sequence
  Description of Artificial Sequence: Synthetic oligonucleotide
ucagccgcuggaacugcca

SEQ ID NO: 13061 - RNA, 19 nt, Artificial Sequence
  Description of Artificial Sequence: Synthetic oligonucleotide
uacagccgcuggaacugcc

SEQ ID NO: 13062 - RNA, 19 nt, Artificial Sequence
  Description of Artificial Sequence: Synthetic oligonucleotide
ugacagccgcuggaacugc

SEQ ID NO: 13063 - RNA, 19 nt, Artificial Sequence
  Description of Artificial Sequence: Synthetic oligonucleotide
uggacagccgcuggaacug

SEQ ID NO: 13064 - RNA, 19 nt, Artificial Sequence
  Description of Artificial Sequence: Synthetic oligonucleotide
ugggacagccgcuggaacu

SEQ ID NO: 13065 - RNA, 19 nt, Artificial Sequence
  Description of Artificial Sequence: Synthetic oligonucleotide
uagggacagccgcuggaac

SEQ ID NO: 13066 - RNA, 19 nt, Artificial Sequence
  Description of Artificial Sequence: Synthetic oligonucleotide
ucagggacagccgcuggaa

SEQ ID NO: 13067 - RNA, 19 nt, Artificial Sequence
  Description of Artificial Sequence: Synthetic oligonucleotide
ugcagggacagccgcugga

SEQ ID NO: 13068 - RNA, 19 nt, Artificial Sequence
  Description of Artificial Sequence: Synthetic oligonucleotide
ucgcagggacagccgcugg

SEQ ID NO: 13069 - RNA, 19 nt, Artificial Sequence
  Description of Artificial Sequence: Synthetic oligonucleotide
uccgcagggacagccgcug

SEQ ID NO: 13070 - RNA, 19 nt, Artificial Sequence
  Description of Artificial Sequence: Synthetic oligonucleotide
ugccgcagggacagccgcu

SEQ ID NO: 13071 - RNA, 19 nt, Artificial Sequence
  Description of Artificial Sequence: Synthetic oligonucleotide
uugccgcagggacagccgc

SEQ ID NO: 13072 - RNA, 19 nt, Artificial Sequence
  Description of Artificial Sequence: Synthetic oligonucleotide
ucugccgcagggacagccg

SEQ ID NO: 13073 - RNA, 19 nt, Artificial Sequence
  Description of Artificial Sequence: Synthetic oligonucleotide
uucugccgcagggacagcc

SEQ ID NO: 13074 - RNA, 19 nt, Artificial Sequence
  Description of Artificial Sequence: Synthetic oligonucleotide
ucucugccgcagggacagc

SEQ ID NO: 13075 - RNA, 19 nt, Artificial Sequence
  Description of Artificial Sequence: Synthetic oligonucleotide
uccucugccgcagggacag

SEQ ID NO: 13076 - RNA, 19 nt, Artificial Sequence
  Description of Artificial Sequence: Synthetic oligonucleotide
ugccucugccgcagggaca

SEQ ID NO: 13077 - RNA, 19 nt, Artificial Sequence
  Description of Artificial Sequence: Synthetic oligonucleotide
uagccucugccgcagggac

SEQ ID NO: 13078 - RNA, 19 nt, Artificial Sequence
  Description of Artificial Sequence: Synthetic oligonucleotide
ucagccucugccgcaggga

SEQ ID NO: 13079 - RNA, 19 nt, Artificial Sequence
  Description of Artificial Sequence: Synthetic oligonucleotide
uucagccucugccgcaggg

SEQ ID NO: 13080 - RNA, 19 nt, Artificial Sequence
  Description of Artificial Sequence: Synthetic oligonucleotide
ucucagccucugccgcagg

SEQ ID NO: 13081 - RNA, 19 nt, Artificial Sequence
  Description of Artificial Sequence: Synthetic oligonucleotide
uccucagccucugccgcag

SEQ ID NO: 13082 - RNA, 19 nt, Artificial Sequence
  Description of Artificial Sequence: Synthetic oligonucleotide
ugccucagccucugccgca

SEQ ID NO: 13083 - RNA, 19 nt, Artificial Sequence
  Description of Artificial Sequence: Synthetic oligonucleotide
uggccucagccucugccgc

SEQ ID NO: 13084 - RNA, 19 nt, Artificial Sequence
  Description of Artificial Sequence: Synthetic oligonucleotide
ucggccucagccucugccg

SEQ ID NO: 13085 - RNA, 19 nt, Artificial Sequence
  Description of Artificial Sequence: Synthetic oligonucleotide
uucggccucagccucugcc

SEQ ID NO: 13086 - RNA, 19 nt, Artificial Sequence
  Description of Artificial Sequence: Synthetic oligonucleotide
ucucggccucagccucugc

SEQ ID NO: 13087 - RNA, 19 nt, Artificial Sequence
  Description of Artificial Sequence: Synthetic oligonucleotide
uccucggccucagccucug

SEQ ID NO: 13088 - RNA, 19 nt, Artificial Sequence
  Description of Artificial Sequence: Synthetic oligonucleotide
uaccucggccucagccucu

SEQ ID NO: 13089 - RNA, 19 nt, Artificial Sequence
  Description of Artificial Sequence: Synthetic oligonucleotide
ucaccucggccucagccuc

SEQ ID NO: 13090 - RNA, 19 nt, Artificial Sequence
  Description of Artificial Sequence: Synthetic oligonucleotide
uucaccucggccucagccu

SEQ ID NO: 13091 - RNA, 19 nt, Artificial Sequence
  Description of Artificial Sequence: Synthetic oligonucleotide
ugucaccucggccucagcc

SEQ ID NO: 13092 - RNA, 19 nt, Artificial Sequence
  Description of Artificial Sequence: Synthetic oligonucleotide
ucgucaccucggccucagc

SEQ ID NO: 13093 - RNA, 19 nt, Artificial Sequence
  Description of Artificial Sequence: Synthetic oligonucleotide
ugcgucaccucggccucag

SEQ ID NO: 13094 - RNA, 19 nt, Artificial Sequence
  Description of Artificial Sequence: Synthetic oligonucleotide
uagcgucaccucggccuca

SEQ ID NO: 13095 - RNA, 19 nt, Artificial Sequence
  Description of Artificial Sequence: Synthetic oligonucleotide
ucagcgucaccucggccuc

SEQ ID NO: 13096 - RNA, 19 nt, Artificial Sequence
  Description of Artificial Sequence: Synthetic oligonucleotide
ugcagcgucaccucggccu

SEQ ID NO: 13097 - RNA, 19 nt, Artificial Sequence
  Description of Artificial Sequence: Synthetic oligonucleotide
ucgcagcgucaccucggcc

SEQ ID NO: 13098 - RNA, 19 nt, Artificial Sequence
  Description of Artificial Sequence: Synthetic oligonucleotide
uccgcagcgucaccucggc

SEQ ID NO: 13099 - RNA, 19 nt, Artificial Sequence
  Description of Artificial Sequence: Synthetic oligonucleotide
ucccgcagcgucaccucgg

SEQ ID NO: 13100 - RNA, 19 nt, Artificial Sequence
  Description of Artificial Sequence: Synthetic oligonucleotide
uucccgcagcgucaccucg

SEQ ID NO: 13101 - RNA, 19 nt, Artificial Sequence
  Description of Artificial Sequence: Synthetic oligonucleotide
ucucccgcagcgucaccuc

SEQ ID NO: 13102 - RNA, 19 nt, Artificial Sequence
  Description of Artificial Sequence: Synthetic oligonucleotide
ugcucccgcagcgucaccu

SEQ ID NO: 13103 - RNA, 19 nt, Artificial Sequence
  Description of Artificial Sequence: Synthetic oligonucleotide
uagcucccgcagcgucacc

SEQ ID NO: 13104 - RNA, 19 nt, Artificial Sequence
  Description of Artificial Sequence: Synthetic oligonucleotide
ugagcucccgcagcgucac

SEQ ID NO: 13105 - RNA, 19 nt, Artificial Sequence
  Description of Artificial Sequence: Synthetic oligonucleotide
uggagcucccgcagcguca

SEQ ID NO: 13106 - RNA, 19 nt, Artificial Sequence
  Description of Artificial Sequence: Synthetic oligonucleotide
uuggagcucccgcagcguc

SEQ ID NO: 13107 - RNA, 19 nt, Artificial Sequence
  Description of Artificial Sequence: Synthetic oligonucleotide
ucuggagcucccgcagcgu

SEQ ID NO: 13108 - RNA, 19 nt, Artificial Sequence
  Description of Artificial Sequence: Synthetic oligonucleotide
uccuggagcucccgcagcg

SEQ ID NO: 13109 - RNA, 19 nt, Artificial Sequence
  Description of Artificial Sequence: Synthetic oligonucleotide
uuccuggagcucccgcagc

SEQ ID NO: 13110 - RNA, 19 nt, Artificial Sequence
  Description of Artificial Sequence: Synthetic oligonucleotide
uuuccuggagcucccgcag

SEQ ID NO: 13111 - RNA, 19 nt, Artificial Sequence
  Description of Artificial Sequence: Synthetic oligonucleotide
ucuuccuggagcucccgca

SEQ ID NO: 13112 - RNA, 19 nt, Artificial Sequence
  Description of Artificial Sequence: Synthetic oligonucleotide
ugcuuccuggagcucccgc

SEQ ID NO: 13113 - RNA, 19 nt, Artificial Sequence
  Description of Artificial Sequence: Synthetic oligonucleotide
uggcuuccuggagcucccg

SEQ ID NO: 13114 - RNA, 19 nt, Artificial Sequence
  Description of Artificial Sequence: Synthetic oligonucleotide
ugggcuuccuggagcuccc

SEQ ID NO: 13115 - RNA, 19 nt, Artificial Sequence
  Description of Artificial Sequence: Synthetic oligonucleotide
uagggcuuccuggagcucc

SEQ ID NO: 13116 - RNA, 19 nt, Artificial Sequence
  Description of Artificial Sequence: Synthetic oligonucleotide
ucagggcuuccuggagcuc

SEQ ID NO: 13117 - RNA, 19 nt, Artificial Sequence
  Description of Artificial Sequence: Synthetic oligonucleotide
uccagggcuuccuggagcu

SEQ ID NO: 13118 - RNA, 19 nt, Artificial Sequence
  Description of Artificial Sequence: Synthetic oligonucleotide
uuccagggcuuccuggagc

SEQ ID NO: 13119 - RNA, 19 nt, Artificial Sequence
  Description of Artificial Sequence: Synthetic oligonucleotide
ucuccagggcuuccuggag

SEQ ID NO: 13120 - RNA, 19 nt, Artificial Sequence
  Description of Artificial Sequence: Synthetic oligonucleotide
uccuccagggcuuccugga

SEQ ID NO: 13121 - RNA, 19 nt, Artificial Sequence
  Description of Artificial Sequence: Synthetic oligonucleotide
uuccuccagggcuuccugg

SEQ ID NO: 13122 - RNA, 19 nt, Artificial Sequence
  Description of Artificial Sequence: Synthetic oligonucleotide
ucuccuccagggcuuccug

SEQ ID NO: 13123 - RNA, 19 nt, Artificial Sequence
  Description of Artificial Sequence: Synthetic oligonucleotide
uccuccuccagggcuuccu

SEQ ID NO: 13124 - RNA, 19 nt, Artificial Sequence
  Description of Artificial Sequence: Synthetic oligonucleotide
uuccuccuccagggcuucc

SEQ ID NO: 13125 - RNA, 19 nt, Artificial Sequence
  Description of Artificial Sequence: Synthetic oligonucleotide
ucuccuccuccagggcuuc

SEQ ID NO: 13126 - RNA, 19 nt, Artificial Sequence
  Description of Artificial Sequence: Synthetic oligonucleotide
uccuccuccuccagggcuu

SEQ ID NO: 13127 - RNA, 19 nt, Artificial Sequence
  Description of Artificial Sequence: Synthetic oligonucleotide
uaccuccuccuccagggcu

SEQ ID NO: 13128 - RNA, 19 nt, Artificial Sequence
  Description of Artificial Sequence: Synthetic oligonucleotide
ucaccuccuccuccagggc

SEQ ID NO: 13129 - RNA, 19 nt, Artificial Sequence
  Description of Artificial Sequence: Synthetic oligonucleotide
ugcaccuccuccuccaggg

SEQ ID NO: 13130 - RNA, 19 nt, Artificial Sequence
  Description of Artificial Sequence: Synthetic oligonucleotide
uagcaccuccuccuccagg

SEQ ID NO: 13131 - RNA, 19 nt, Artificial Sequence
  Description of Artificial Sequence: Synthetic oligonucleotide
ugagcaccuccuccuccag

SEQ ID NO: 13132 - RNA, 19 nt, Artificial Sequence
  Description of Artificial Sequence: Synthetic oligonucleotide
uugagcaccuccuccucca

SEQ ID NO: 13133 - RNA, 19 nt, Artificial Sequence
  Description of Artificial Sequence: Synthetic oligonucleotide
ugugagcaccuccuccucc

SEQ ID NO: 13134 - RNA, 19 nt, Artificial Sequence
  Description of Artificial Sequence: Synthetic oligonucleotide
uggugagcaccuccuccuc

SEQ ID NO: 13135 - RNA, 19 nt, Artificial Sequence
  Description of Artificial Sequence: Synthetic oligonucleotide
ugggugagcaccuccuccu

SEQ ID NO: 13136 - RNA, 19 nt, Artificial Sequence
  Description of Artificial Sequence: Synthetic oligonucleotide
ucgggugagcaccuccucc

SEQ ID NO: 13137 - RNA, 19 nt, Artificial Sequence
  Description of Artificial Sequence: Synthetic oligonucleotide
uccgggugagcaccuccuc

SEQ ID NO: 13138 - RNA, 19 nt, Artificial Sequence
  Description of Artificial Sequence: Synthetic oligonucleotide
ugccgggugagcaccuccu

SEQ ID NO: 13139 - RNA, 19 nt, Artificial Sequence
  Description of Artificial Sequence: Synthetic oligonucleotide
uugccgggugagcaccucc

SEQ ID NO: 13140 - RNA, 19 nt, Artificial Sequence
  Description of Artificial Sequence: Synthetic oligonucleotide
ucugccgggugagcaccuc

SEQ ID NO: 13141 - RNA, 19 nt, Artificial Sequence
  Description of Artificial Sequence: Synthetic oligonucleotide
uucugccgggugagcaccu

SEQ ID NO: 13142 - RNA, 19 nt, Artificial Sequence
  Description of Artificial Sequence: Synthetic oligonucleotide
ucucugccgggugagcacc

SEQ ID NO: 13143 - RNA, 19 nt, Artificial Sequence
  Description of Artificial Sequence: Synthetic oligonucleotide
ugcucugccgggugagcac

SEQ ID NO: 13144 - RNA, 19 nt, Artificial Sequence
  Description of Artificial Sequence: Synthetic oligonucleotide
uggcucugccgggugagca

SEQ ID NO: 13145 - RNA, 19 nt, Artificial Sequence
  Description of Artificial Sequence: Synthetic oligonucleotide
uaggcucugccgggugagc

SEQ ID NO: 13146 - RNA, 19 nt, Artificial Sequence
  Description of Artificial Sequence: Synthetic oligonucleotide
ucaggcucugccgggugag

SEQ ID NO: 13147 - RNA, 19 nt, Artificial Sequence
  Description of Artificial Sequence: Synthetic oligonucleotide
uucaggcucugccggguga

SEQ ID NO: 13148 - RNA, 19 nt, Artificial Sequence
  Description of Artificial Sequence: Synthetic oligonucleotide
ucucaggcucugccgggug

SEQ ID NO: 13149 - RNA, 19 nt, Artificial Sequence
  Description of Artificial Sequence: Synthetic oligonucleotide
ugcucaggcucugccgggu

SEQ ID NO: 13150 - RNA, 19 nt, Artificial Sequence
  Description of Artificial Sequence: Synthetic oligonucleotide
uggcucaggcucugccggg

SEQ ID NO: 13151 - RNA, 19 nt, Artificial Sequence
  Description of Artificial Sequence: Synthetic oligonucleotide
ucggcucaggcucugccgg

SEQ ID NO: 13152 - RNA, 19 nt, Artificial Sequence
  Description of Artificial Sequence: Synthetic oligonucleotide
uccggcucaggcucugccg

SEQ ID NO: 13153 - RNA, 19 nt, Artificial Sequence
  Description of Artificial Sequence: Synthetic oligonucleotide
ucccggcucaggcucugcc

SEQ ID NO: 13154 - RNA, 19 nt, Artificial Sequence
  Description of Artificial Sequence: Synthetic oligonucleotide
uucccggcucaggcucugc

SEQ ID NO: 13155 - RNA, 19 nt, Artificial Sequence
  Description of Artificial Sequence: Synthetic oligonucleotide
ucucccggcucaggcucug

SEQ ID NO: 13156 - RNA, 19 nt, Artificial Sequence
  Description of Artificial Sequence: Synthetic oligonucleotide
uucucccggcucaggcucu

SEQ ID NO: 13157 - RNA, 19 nt, Artificial Sequence
  Description of Artificial Sequence: Synthetic oligonucleotide
uaucucccggcucaggcuc

SEQ ID NO: 13158 - RNA, 19 nt, Artificial Sequence
  Description of Artificial Sequence: Synthetic oligonucleotide
ucaucucccggcucaggcu

SEQ ID NO: 13159 - RNA, 19 nt, Artificial Sequence
  Description of Artificial Sequence: Synthetic oligonucleotide
uccaucucccggcucaggc

SEQ ID NO: 13160 - RNA, 19 nt, Artificial Sequence
  Description of Artificial Sequence: Synthetic oligonucleotide
uuccaucucccggcucagg

SEQ ID NO: 13161 - RNA, 19 nt, Artificial Sequence
  Description of Artificial Sequence: Synthetic oligonucleotide
ucuccaucucccggcucag

SEQ ID NO: 13162 - RNA, 19 nt, Artificial Sequence
  Description of Artificial Sequence: Synthetic oligonucleotide
uccuccaucucccggcuca

SEQ ID NO: 13163 - RNA, 19 nt, Artificial Sequence
  Description of Artificial Sequence: Synthetic oligonucleotide
ugccuccaucucccggcuc

SEQ ID NO: 13164 - RNA, 19 nt, Artificial Sequence
  Description of Artificial Sequence: Synthetic oligonucleotide
uggccuccaucucccggcu

SEQ ID NO: 13165 - RNA, 19 nt, Artificial Sequence
  Description of Artificial Sequence: Synthetic oligonucleotide
uuggccuccaucucccggc

SEQ ID NO: 13166 - RNA, 19 nt, Artificial Sequence
  Description of Artificial Sequence: Synthetic oligonucleotide
uauggccuccaucucccgg

SEQ ID NO: 13167 - RNA, 19 nt, Artificial Sequence
  Description of Artificial Sequence: Synthetic oligonucleotide
ugauggccuccaucucccg

SEQ ID NO: 13168 - RNA, 19 nt, Artificial Sequence
  Description of Artificial Sequence: Synthetic oligonucleotide
uggauggccuccaucuccc

SEQ ID NO: 13169 - RNA, 19 nt, Artificial Sequence
  Description of Artificial Sequence: Synthetic oligonucleotide
ucggauggccuccaucucc

SEQ ID NO: 13170 - RNA, 19 nt, Artificial Sequence
  Description of Artificial Sequence: Synthetic oligonucleotide
ugcggauggccuccaucuc

SEQ ID NO: 13171 - RNA, 19 nt, Artificial Sequence
  Description of Artificial Sequence: Synthetic oligonucleotide
uugcggauggccuccaucu

SEQ ID NO: 13172 - RNA, 19 nt, Artificial Sequence
  Description of Artificial Sequence: Synthetic oligonucleotide
ugugcggauggccuccauc

SEQ ID NO: 13173 - RNA, 19 nt, Artificial Sequence
  Description of Artificial Sequence: Synthetic oligonucleotide
ucgugcggauggccuccau

SEQ ID NO: 13174 - RNA, 19 nt, Artificial Sequence
  Description of Artificial Sequence: Synthetic oligonucleotide
uccgugcggauggccucca

SEQ ID NO: 13175 - RNA, 19 nt, Artificial Sequence
  Description of Artificial Sequence: Synthetic oligonucleotide
uuccgugcggauggccucc

SEQ ID NO: 13176 - RNA, 19 nt, Artificial Sequence
  Description of Artificial Sequence: Synthetic oligonucleotide
uguccgugcggauggccuc

SEQ ID NO: 13177 - RNA, 19 nt, Artificial Sequence
  Description of Artificial Sequence: Synthetic oligonucleotide
uuguccgugcggauggccu

SEQ ID NO: 13178 - RNA, 19 nt, Artificial Sequence
  Description of Artificial Sequence: Synthetic oligonucleotide
uuuguccgugcggauggcc

SEQ ID NO: 13179 - RNA, 19 nt, Artificial Sequence
  Description of Artificial Sequence: Synthetic oligonucleotide
uguuguccgugcggauggc

SEQ ID NO: 13180 - RNA, 19 nt, Artificial Sequence
  Description of Artificial Sequence: Synthetic oligonucleotide
ugguuguccgugcggaugg

SEQ ID NO: 13181 - RNA, 19 nt, Artificial Sequence
  Description of Artificial Sequence: Synthetic oligonucleotide
uugguuguccgugcggaug

SEQ ID NO: 13182 - RNA, 19 nt, Artificial Sequence
  Description of Artificial Sequence: Synthetic oligonucleotide
ucugguuguccgugcggau

SEQ ID NO: 13183 - RNA, 19 nt, Artificial Sequence
  Description of Artificial Sequence: Synthetic oligonucleotide
uucugguuguccgugcgga

SEQ ID NO: 13184 - RNA, 19 nt, Artificial Sequence
  Description of Artificial Sequence: Synthetic oligonucleotide
uuucugguuguccgugcgg

SEQ ID NO: 13185 - RNA, 19 nt, Artificial Sequence
  Description of Artificial Sequence: Synthetic oligonucleotide
uguucugguuguccgugcg

SEQ ID NO: 13186 - RNA, 19 nt, Artificial Sequence
  Description of Artificial Sequence: Synthetic oligonucleotide
uaguucugguuguccgugc

SEQ ID NO: 13187 - RNA, 19 nt, Artificial Sequence
  Description of Artificial Sequence: Synthetic oligonucleotide
uaaguucugguuguccgug

SEQ ID NO: 13188 - RNA, 19 nt, Artificial Sequence
  Description of Artificial Sequence: Synthetic oligonucleotide
ugaaguucugguuguccgu

SEQ ID NO: 13189 - RNA, 19 nt, Artificial Sequence
  Description of Artificial Sequence: Synthetic oligonucleotide
ucgaaguucugguuguccg

SEQ ID NO: 13190 - RNA, 19 nt, Artificial Sequence
  Description of Artificial Sequence: Synthetic oligonucleotide
ugcgaaguucugguugucc

SEQ ID NO: 13191 - RNA, 19 nt, Artificial Sequence
  Description of Artificial Sequence: Synthetic oligonucleotide
uggcgaaguucugguuguc

SEQ ID NO: 13192 - RNA, 19 nt, Artificial Sequence
  Description of Artificial Sequence: Synthetic oligonucleotide
uuggcgaaguucugguugu

SEQ ID NO: 13193 - RNA, 19 nt, Artificial Sequence
  Description of Artificial Sequence: Synthetic oligonucleotide
ucuggcgaaguucugguug

SEQ ID NO: 13194 - RNA, 19 nt, Artificial Sequence
  Description of Artificial Sequence: Synthetic oligonucleotide
uacuggcgaaguucugguu

SEQ ID NO: 13195 - RNA, 19 nt, Artificial Sequence
  Description of Artificial Sequence: Synthetic oligonucleotide
ugacuggcgaaguucuggu

SEQ ID NO: 13196 - RNA, 19 nt, Artificial Sequence
  Description of Artificial Sequence: Synthetic oligonucleotide
uugacuggcgaaguucugg

SEQ ID NO: 13197 - RNA, 19 nt, Artificial Sequence
  Description of Artificial Sequence: Synthetic oligonucleotide
uuugacuggcgaaguucug

SEQ ID NO: 13198 - RNA, 19 nt, Artificial Sequence
  Description of Artificial Sequence: Synthetic oligonucleotide
uguugacuggcgaaguucu

SEQ ID NO: 13199 - RNA, 19 nt, Artificial Sequence
  Description of Artificial Sequence: Synthetic oligonucleotide
uaguugacuggcgaaguuc

SEQ ID NO: 13200 - RNA, 19 nt, Artificial Sequence
  Description of Artificial Sequence: Synthetic oligonucleotide
uuaguugacuggcgaaguu

SEQ ID NO: 13201 - RNA, 19 nt, Artificial Sequence
  Description of Artificial Sequence: Synthetic oligonucleotide
uguaguugacuggcgaagu

SEQ ID NO: 13202 - RNA, 19 nt, Artificial Sequence
  Description of Artificial Sequence: Synthetic oligonucleotide
ucguaguugacuggcgaag

SEQ ID NO: 13203 - RNA, 19 nt, Artificial Sequence
  Description of Artificial Sequence: Synthetic oligonucleotide
ugcguaguugacuggcgaa

SEQ ID NO: 13204 - RNA, 19 nt, Artificial Sequence
  Description of Artificial Sequence: Synthetic oligonucleotide
ucgcguaguugacuggcga

SEQ ID NO: 13205 - RNA, 19 nt, Artificial Sequence
  Description of Artificial Sequence: Synthetic oligonucleotide
uucgcguaguugacuggcg

SEQ ID NO: 13206 - RNA, 19 nt, Artificial Sequence
  Description of Artificial Sequence: Synthetic oligonucleotide
ucucgcguaguugacuggc

SEQ ID NO: 13207 - RNA, 19 nt, Artificial Sequence
  Description of Artificial Sequence: Synthetic oligonucleotide
uccucgcguaguugacugg

SEQ ID NO: 13208 - RNA, 19 nt, Artificial Sequence
  Description of Artificial Sequence: Synthetic oligonucleotide
ugccucgcguaguugacug

SEQ ID NO: 13209 - RNA, 19 nt, Artificial Sequence
  Description of Artificial Sequence: Synthetic oligonucleotide
uugccucgcguaguugacu

SEQ ID NO: 13210 - RNA, 19 nt, Artificial Sequence
  Description of Artificial Sequence: Synthetic oligonucleotide
ucugccucgcguaguugac

SEQ ID NO: 13211 - RNA, 19 nt, Artificial Sequence
  Description of Artificial Sequence: Synthetic oligonucleotide
uucugccucgcguaguuga

SEQ ID NO: 13212 - RNA, 19 nt, Artificial Sequence
  Description of Artificial Sequence: Synthetic oligonucleotide
ucucugccucgcguaguug

SEQ ID NO: 13213 - RNA, 19 nt, Artificial Sequence
  Description of Artificial Sequence: Synthetic oligonucleotide
uccucugccucgcguaguu

SEQ ID NO: 13214 - RNA, 19 nt, Artificial Sequence
  Description of Artificial Sequence: Synthetic oligonucleotide
ugccucugccucgcguagu

SEQ ID NO: 13215 - RNA, 19 nt, Artificial Sequence
  Description of Artificial Sequence: Synthetic oligonucleotide
uagccucugccucgcguag

SEQ ID NO: 13216 - RNA, 19 nt, Artificial Sequence
  Description of Artificial Sequence: Synthetic oligonucleotide
ugagccucugccucgcgua

SEQ ID NO: 13217 - RNA, 19 nt, Artificial Sequence
  Description of Artificial Sequence: Synthetic oligonucleotide
ucgagccucugccucgcgu

SEQ ID NO: 13218 - RNA, 19 nt, Artificial Sequence
  Description of Artificial Sequence: Synthetic oligonucleotide
uccgagccucugccucgcg

SEQ ID NO: 13219 - RNA, 19 nt, Artificial Sequence
  Description of Artificial Sequence: Synthetic oligonucleotide
uuccgagccucugccucgc

SEQ ID NO: 13220 - RNA, 19 nt, Artificial Sequence
  Description of Artificial Sequence: Synthetic oligonucleotide
uuuccgagccucugccucg

SEQ ID NO: 13221 - RNA, 19 nt, Artificial Sequence
  Description of Artificial Sequence: Synthetic oligonucleotide
uguuccgagccucugccuc

SEQ ID NO: 13222 - RNA, 19 nt, Artificial Sequence
  Description of Artificial Sequence: Synthetic oligonucleotide
ugguuccgagccucugccu

SEQ ID NO: 13223 - RNA, 19 nt, Artificial Sequence
  Description of Artificial Sequence: Synthetic oligonucleotide
ucgguuccgagccucugcc

SEQ ID NO: 13224 - RNA, 19 nt, Artificial Sequence
  Description of Artificial Sequence: Synthetic oligonucleotide
uccgguuccgagccucugc

SEQ ID NO: 13225 - RNA, 19 nt, Artificial Sequence
  Description of Artificial Sequence: Synthetic oligonucleotide
ucccgguuccgagccucug

SEQ ID NO: 13226 - RNA, 19 nt, Artificial Sequence
  Description of Artificial Sequence: Synthetic oligonucleotide
uucccgguuccgagccucu

SEQ ID NO: 13227 - RNA, 19 nt, Artificial Sequence
  Description of Artificial Sequence: Synthetic oligonucleotide
ugucccgguuccgagccuc

SEQ ID NO: 13228 - RNA, 19 nt, Artificial Sequence
  Description of Artificial Sequence: Synthetic oligonucleotide
uggucccgguuccgagccu

SEQ ID NO: 13229 - RNA, 19 nt, Artificial Sequence
  Description of Artificial Sequence: Synthetic oligonucleotide
uaggucccgguuccgagcc

SEQ ID NO: 13230 - RNA, 19 nt, Artificial Sequence
  Description of Artificial Sequence: Synthetic oligonucleotide
uuaggucccgguuccgagc

SEQ ID NO: 13231 - RNA, 19 nt, Artificial Sequence
  Description of Artificial Sequence: Synthetic oligonucleotide
ucuaggucccgguuccgag

SEQ ID NO: 13232 - RNA, 19 nt, Artificial Sequence
  Description of Artificial Sequence: Synthetic oligonucleotide
uucuaggucccgguuccga

SEQ ID NO: 13233 - RNA, 19 nt, Artificial Sequence
  Description of Artificial Sequence: Synthetic oligonucleotide
ucucuaggucccgguuccg

SEQ ID NO: 13234 - RNA, 19 nt, Artificial Sequence
  Description of Artificial Sequence: Synthetic oligonucleotide
uccucuaggucccgguucc

SEQ ID NO: 13235 - RNA, 19 nt, Artificial Sequence
  Description of Artificial Sequence: Synthetic oligonucleotide
ugccucuaggucccgguuc

SEQ ID NO: 13236 - RNA, 19 nt, Artificial Sequence
  Description of Artificial Sequence: Synthetic oligonucleotide
uugccucuaggucccgguu

SEQ ID NO: 13237 - RNA, 19 nt, Artificial Sequence
  Description of Artificial Sequence: Synthetic oligonucleotide
ugugccucuaggucccggu

SEQ ID NO: 13238 - RNA, 19 nt, Artificial Sequence
  Description of Artificial Sequence: Synthetic oligonucleotide
uugugccucuaggucccgg

SEQ ID NO: 13239 - RNA, 19 nt, Artificial Sequence
  Description of Artificial Sequence: Synthetic oligonucleotide
ugugugccucuaggucccg

SEQ ID NO: 13240 - RNA, 19 nt, Artificial Sequence
  Description of Artificial Sequence: Synthetic oligonucleotide
ucgugugccucuagguccc

SEQ ID NO: 13241 - RNA, 19 nt, Artificial Sequence
  Description of Artificial Sequence: Synthetic oligonucleotide
uacgugugccucuaggucc

SEQ ID NO: 13242 - RNA, 19 nt, Artificial Sequence
  Description of Artificial Sequence: Synthetic oligonucleotide
ugacgugugccucuagguc

SEQ ID NO: 13243 - RNA, 19 nt, Artificial Sequence
  Description of Artificial Sequence: Synthetic oligonucleotide
uggacgugugccucuaggu

SEQ ID NO: 13244 - RNA, 19 nt, Artificial Sequence
  Description of Artificial Sequence: Synthetic oligonucleotide
ucggacgugugccucuagg

SEQ ID NO: 13245 - RNA, 19 nt, Artificial Sequence
  Description of Artificial Sequence: Synthetic oligonucleotide
uccggacgugugccucuag

SEQ ID NO: 13246 - RNA, 19 nt, Artificial Sequence
  Description of Artificial Sequence: Synthetic oligonucleotide
ugccggacgugugccucua

SEQ ID NO: 13247 - RNA, 19 nt, Artificial Sequence
  Description of Artificial Sequence: Synthetic oligonucleotide
uugccggacgugugccucu

SEQ ID NO: 13248 - RNA, 19 nt, Artificial Sequence
  Description of Artificial Sequence: Synthetic oligonucleotide
ucugccggacgugugccuc

SEQ ID NO: 13249 - RNA, 19 nt, Artificial Sequence
  Description of Artificial Sequence: Synthetic oligonucleotide
uacugccggacgugugccu

SEQ ID NO: 13250 - RNA, 19 nt, Artificial Sequence
  Description of Artificial Sequence: Synthetic oligonucleotide
uaacugccggacgugugcc

SEQ ID NO: 13251 - RNA, 19 nt, Artificial Sequence
  Description of Artificial Sequence: Synthetic oligonucleotide
ucaacugccggacgugugc

SEQ ID NO: 13252 - RNA, 19 nt, Artificial Sequence
  Description of Artificial Sequence: Synthetic oligonucleotide
ugcaacugccggacgugug

SEQ ID NO: 13253 - RNA, 19 nt, Artificial Sequence
  Description of Artificial Sequence: Synthetic oligonucleotide
uugcaacugccggacgugu

SEQ ID NO: 13254 - RNA, 19 nt, Artificial Sequence
  Description of Artificial Sequence: Synthetic oligonucleotide
ucugcaacugccggacgug

SEQ ID NO: 13255 - RNA, 19 nt, Artificial Sequence
  Description of Artificial Sequence: Synthetic oligonucleotide
uccugcaacugccggacgu

SEQ ID NO: 13256 - RNA, 19 nt, Artificial Sequence
  Description of Artificial Sequence: Synthetic oligonucleotide
uuccugcaacugccggacg

SEQ ID NO: 13257 - RNA, 19 nt, Artificial Sequence
  Description of Artificial Sequence: Synthetic oligonucleotide
ucuccugcaacugccggac

SEQ ID NO: 13258 - RNA, 19 nt, Artificial Sequence
  Description of Artificial Sequence: Synthetic oligonucleotide
ugcuccugcaacugccgga

SEQ ID NO: 13259 - RNA, 19 nt, Artificial Sequence
  Description of Artificial Sequence: Synthetic oligonucleotide
ucgcuccugcaacugccgg

SEQ ID NO: 13260 - RNA, 19 nt, Artificial Sequence
  Description of Artificial Sequence: Synthetic oligonucleotide
uccgcuccugcaacugccg

SEQ ID NO: 13261 - RNA, 19 nt, Artificial Sequence
  Description of Artificial Sequence: Synthetic oligonucleotide
uuccgcuccugcaacugcc

SEQ ID NO: 13262 - RNA, 19 nt, Artificial Sequence
  Description of Artificial Sequence: Synthetic oligonucleotide
uauccgcuccugcaacugc

SEQ ID NO: 13263 - RNA, 19 nt, Artificial Sequence
  Description of Artificial Sequence: Synthetic oligonucleotide
ucauccgcuccugcaacug

SEQ ID NO: 13264 - RNA, 19 nt, Artificial Sequence
  Description of Artificial Sequence: Synthetic oligonucleotide
uccauccgcuccugcaacu

SEQ ID NO: 13265 - RNA, 19 nt, Artificial Sequence
  Description of Artificial Sequence: Synthetic oligonucleotide
uuccauccgcuccugcaac

SEQ ID NO: 13266 - RNA, 19 nt, Artificial Sequence
  Description of Artificial Sequence: Synthetic oligonucleotide
ucuccauccgcuccugcaa

SEQ ID NO: 13267 - RNA, 19 nt, Artificial Sequence
  Description of Artificial Sequence: Synthetic oligonucleotide
uacuccauccgcuccugca

SEQ ID NO: 13268 - RNA, 19 nt, Artificial Sequence
  Description of Artificial Sequence: Synthetic oligonucleotide
uaacuccauccgcuccugc

SEQ ID NO: 13269 - RNA, 19 nt, Artificial Sequence
  Description of Artificial Sequence: Synthetic oligonucleotide
ucaacuccauccgcuccug

SEQ ID NO: 13270 - RNA, 19 nt, Artificial Sequence
  Description of Artificial Sequence: Synthetic oligonucleotide
ugcaacuccauccgcuccu

SEQ ID NO: 13271 - RNA, 19 nt, Artificial Sequence
  Description of Artificial Sequence: Synthetic oligonucleotide
uagcaacuccauccgcucc

SEQ ID NO: 13272 - RNA, 19 nt, Artificial Sequence
  Description of Artificial Sequence: Synthetic oligonucleotide
ucagcaacuccauccgcuc

SEQ ID NO: 13273 - RNA, 19 nt, Artificial Sequence
  Description of Artificial Sequence: Synthetic oligonucleotide
ugcagcaacuccauccgcu

SEQ ID NO: 13274 - RNA, 19 nt, Artificial Sequence
  Description of Artificial Sequence: Synthetic oligonucleotide
uugcagcaacuccauccgc

SEQ ID NO: 13275 - RNA, 19 nt, Artificial Sequence
  Description of Artificial Sequence: Synthetic oligonucleotide
ucugcagcaacuccauccg

SEQ ID NO: 13276 - RNA, 19 nt, Artificial Sequence
  Description of Artificial Sequence: Synthetic oligonucleotide
uccugcagcaacuccaucc

SEQ ID NO: 13277 - RNA, 19 nt, Artificial Sequence
  Description of Artificial Sequence: Synthetic oligonucleotide
ugccugcagcaacuccauc

SEQ ID NO: 13278 - RNA, 19 nt, Artificial Sequence
  Description of Artificial Sequence: Synthetic oligonucleotide
uugccugcagcaacuccau

SEQ ID NO: 13279 - RNA, 19 nt, Artificial Sequence
  Description of Artificial Sequence: Synthetic oligonucleotide
ucugccugcagcaacucca

SEQ ID NO: 13280 - RNA, 19 nt, Artificial Sequence
  Description of Artificial Sequence: Synthetic oligonucleotide
uucugccugcagcaacucc

SEQ ID NO: 13281 - RNA, 19 nt, Artificial Sequence
  Description of Artificial Sequence: Synthetic oligonucleotide
ucucugccugcagcaacuc

SEQ ID NO: 13282 - RNA, 19 nt, Artificial Sequence
  Description of Artificial Sequence: Synthetic oligonucleotide
uccucugccugcagcaacu

SEQ ID NO: 13283 - RNA, 19 nt, Artificial Sequence
  Description of Artificial Sequence: Synthetic oligonucleotide
ucccucugccugcagcaac

SEQ ID NO: 13284 - RNA, 19 nt, Artificial Sequence
  Description of Artificial Sequence: Synthetic oligonucleotide
uucccucugccugcagcaa

SEQ ID NO: 13285 - RNA, 19 nt, Artificial Sequence
  Description of Artificial Sequence: Synthetic oligonucleotide
ucucccucugccugcagca

SEQ ID NO: 13286 - RNA, 19 nt, Artificial Sequence
  Description of Artificial Sequence: Synthetic oligonucleotide
ugcucccucugccugcagc

SEQ ID NO: 13287 - RNA, 19 nt, Artificial Sequence
  Description of Artificial Sequence: Synthetic oligonucleotide
uggcucccucugccugcag

SEQ ID NO: 13288 - RNA, 19 nt, Artificial Sequence
  Description of Artificial Sequence: Synthetic oligonucleotide
uuggcucccucugccugca

SEQ ID NO: 13289 - RNA, 19 nt, Artificial Sequence
  Description of Artificial Sequence: Synthetic oligonucleotide
uguggcucccucugccugc

SEQ ID NO: 13290 - RNA, 19 nt, Artificial Sequence
  Description of Artificial Sequence: Synthetic oligonucleotide
uuguggcucccucugccug

SEQ ID NO: 13291 - RNA, 19 nt, Artificial Sequence
  Description of Artificial Sequence: Synthetic oligonucleotide
ucuguggcucccucugccu

SEQ ID NO: 13292 - RNA, 19 nt, Artificial Sequence
  Description of Artificial Sequence: Synthetic oligonucleotide
uccuguggcucccucugcc

SEQ ID NO: 13293 - RNA, 19 nt, Artificial Sequence
  Description of Artificial Sequence: Synthetic oligonucleotide
uaccuguggcucccucugc

SEQ ID NO: 13294 - RNA, 19 nt, Artificial Sequence
  Description of Artificial Sequence: Synthetic oligonucleotide
ugaccuguggcucccucug

SEQ ID NO: 13295 - RNA, 19 nt, Artificial Sequence
  Description of Artificial Sequence: Synthetic oligonucleotide
uggaccuguggcucccucu

SEQ ID NO: 13296 - RNA, 19 nt, Artificial Sequence
  Description of Artificial Sequence: Synthetic oligonucleotide
ugggaccuguggcucccuc

SEQ ID NO: 13297 - RNA, 19 nt, Artificial Sequence
  Description of Artificial Sequence: Synthetic oligonucleotide
uagggaccuguggcucccu

SEQ ID NO: 13298 - RNA, 19 nt, Artificial Sequence
  Description of Artificial Sequence: Synthetic oligonucleotide
uuagggaccuguggcuccc

SEQ ID NO: 13299 - RNA, 19 nt, Artificial Sequence
  Description of Artificial Sequence: Synthetic oligonucleotide
ucuagggaccuguggcucc

SEQ ID NO: 13300 - RNA, 19 nt, Artificial Sequence
  Description of Artificial Sequence: Synthetic oligonucleotide
uccuagggaccuguggcuc

SEQ ID NO: 13301 - RNA, 19 nt, Artificial Sequence
  Description of Artificial Sequence: Synthetic oligonucleotide
ugccuagggaccuguggcu

SEQ ID NO: 13302 - RNA, 19 nt, Artificial Sequence
  Description of Artificial Sequence: Synthetic oligonucleotide
uggccuagggaccuguggc

SEQ ID NO: 13303 - RNA, 19 nt, Artificial Sequence
  Description of Artificial Sequence: Synthetic oligonucleotide
uaggccuagggaccugugg

SEQ ID NO: 13304 - RNA, 19 nt, Artificial Sequence
  Description of Artificial Sequence: Synthetic oligonucleotide
ucaggccuagggaccugug

SEQ ID NO: 13305 - RNA, 19 nt, Artificial Sequence
  Description of Artificial Sequence: Synthetic oligonucleotide
uccaggccuagggaccugu

SEQ ID NO: 13306 - RNA, 19 nt, Artificial Sequence
  Description of Artificial Sequence: Synthetic oligonucleotide
ugccaggccuagggaccug

SEQ ID NO: 13307 - RNA, 19 nt, Artificial Sequence
  Description of Artificial Sequence: Synthetic oligonucleotide
uggccaggccuagggaccu

SEQ ID NO: 13308 - RNA, 19 nt, Artificial Sequence
  Description of Artificial Sequence: Synthetic oligonucleotide
uaggccaggccuagggacc

SEQ ID NO: 13309 - RNA, 19 nt, Artificial Sequence
  Description of Artificial Sequence: Synthetic oligonucleotide
uuaggccaggccuagggac

SEQ ID NO: 13310 - RNA, 19 nt, Artificial Sequence
  Description of Artificial Sequence: Synthetic oligonucleotide
uauaggccaggccuaggga

SEQ ID NO: 13311 - RNA, 19 nt, Artificial Sequence
  Description of Artificial Sequence: Synthetic oligonucleotide
ugauaggccaggccuaggg

SEQ ID NO: 13312 - RNA, 19 nt, Artificial Sequence
  Description of Artificial Sequence: Synthetic oligonucleotide
ucgauaggccaggccuagg

SEQ ID NO: 13313 - RNA, 19 nt, Artificial Sequence
  Description of Artificial Sequence: Synthetic oligonucleotide
uccgauaggccaggccuag

SEQ ID NO: 13314 - RNA, 19 nt, Artificial Sequence
  Description of Artificial Sequence: Synthetic oligonucleotide
uuccgauaggccaggccua

SEQ ID NO: 13315 - RNA, 19 nt, Artificial Sequence
  Description of Artificial Sequence: Synthetic oligonucleotide
ucuccgauaggccaggccu

SEQ ID NO: 13316 - RNA, 19 nt, Artificial Sequence
  Description of Artificial Sequence: Synthetic oligonucleotide
uccuccgauaggccaggcc

SEQ ID NO: 13317 - RNA, 19 nt, Artificial Sequence
  Description of Artificial Sequence: Synthetic oligonucleotide
ugccuccgauaggccaggc

SEQ ID NO: 13318 - RNA, 19 nt, Artificial Sequence
  Description of Artificial Sequence: Synthetic oligonucleotide
ucgccuccgauaggccagg

SEQ ID NO: 13319 - RNA, 19 nt, Artificial Sequence
  Description of Artificial Sequence: Synthetic oligonucleotide
ugcgccuccgauaggccag

SEQ ID NO: 13320 - RNA, 19 nt, Artificial Sequence
  Description of Artificial Sequence: Synthetic oligonucleotide
uagcgccuccgauaggcca

SEQ ID NO: 13321 - RNA, 19 nt, Artificial Sequence
  Description of Artificial Sequence: Synthetic oligonucleotide
uaagcgccuccgauaggcc

SEQ ID NO: 13322 - RNA, 19 nt, Artificial Sequence
  Description of Artificial Sequence: Synthetic oligonucleotide
uaaagcgccuccgauaggc

SEQ ID NO: 13323 - RNA, 19 nt, Artificial Sequence
  Description of Artificial Sequence: Synthetic oligonucleotide
ugaaagcgccuccgauagg

SEQ ID NO: 13324 - RNA, 19 nt, Artificial Sequence
  Description of Artificial Sequence: Synthetic oligonucleotide
uggaaagcgccuccgauag

SEQ ID NO: 13325 - RNA, 19 nt, Artificial Sequence
  Description of Artificial Sequence: Synthetic oligonucleotide
ugggaaagcgccuccgaua

SEQ ID NO: 13326 - RNA, 19 nt, Artificial Sequence
  Description of Artificial Sequence: Synthetic oligonucleotide
uagggaaagcgccuccgau

SEQ ID NO: 13327 - RNA, 19 nt, Artificial Sequence
  Description of Artificial Sequence: Synthetic oligonucleotide
ucagggaaagcgccuccga

SEQ ID NO: 13328 - RNA, 19 nt, Artificial Sequence
  Description of Artificial Sequence: Synthetic oligonucleotide
ugcagggaaagcgccuccg

SEQ ID NO: 13329 - RNA, 19 nt, Artificial Sequence
  Description of Artificial Sequence: Synthetic oligonucleotide
uagcagggaaagcgccucc

SEQ ID NO: 13330 - RNA, 19 nt, Artificial Sequence
  Description of Artificial Sequence: Synthetic oligonucleotide
ugagcagggaaagcgccuc

SEQ ID NO: 13331 - RNA, 19 nt, Artificial Sequence
  Description of Artificial Sequence: Synthetic oligonucleotide
uggagcagggaaagcgccu

SEQ ID NO: 13332 - RNA, 19 nt, Artificial Sequence
  Description of Artificial Sequence: Synthetic oligonucleotide
uaggagcagggaaagcgcc

SEQ ID NO: 13333 - RNA, 19 nt, Artificial Sequence
  Description of Artificial Sequence: Synthetic oligonucleotide
ucaggagcagggaaagcgc

SEQ ID NO: 13334 - RNA, 19 nt, Artificial Sequence
  Description of Artificial Sequence: Synthetic oligonucleotide
uacaggagcagggaaagcg

SEQ ID NO: 13335 - RNA, 19 nt, Artificial Sequence
  Description of Artificial Sequence: Synthetic oligonucleotide
uaacaggagcagggaaagc

SEQ ID NO: 13336 - RNA, 19 nt, Artificial Sequence
  Description of Artificial Sequence: Synthetic oligonucleotide
ugaacaggagcagggaaag

SEQ ID NO: 13337 - RNA, 19 nt, Artificial Sequence
  Description of Artificial Sequence: Synthetic oligonucleotide
ucgaacaggagcagggaaa

SEQ ID NO: 13338 - RNA, 19 nt, Artificial Sequence
  Description of Artificial Sequence: Synthetic oligonucleotide
ugcgaacaggagcagggaa

SEQ ID NO: 13339 - RNA, 19 nt, Artificial Sequence
  Description of Artificial Sequence: Synthetic oligonucleotide
uggcgaacaggagcaggga

SEQ ID NO: 13340 - RNA, 19 nt, Artificial Sequence
  Description of Artificial Sequence: Synthetic oligonucleotide
ucggcgaacaggagcaggg

SEQ ID NO: 13341 - RNA, 19 nt, Artificial Sequence
  Description of Artificial Sequence: Synthetic oligonucleotide
uacggcgaacaggagcagg

SEQ ID NO: 13342 - RNA, 19 nt, Artificial Sequence
  Description of Artificial Sequence: Synthetic oligonucleotide
uaacggcgaacaggagcag

SEQ ID NO: 13343 - RNA, 19 nt, Artificial Sequence
  Description of Artificial Sequence: Synthetic oligonucleotide
ucaacggcgaacaggagca

SEQ ID NO: 13344 - RNA, 19 nt, Artificial Sequence
  Description of Artificial Sequence: Synthetic oligonucleotide
uacaacggcgaacaggagc

SEQ ID NO: 13345 - RNA, 19 nt, Artificial Sequence
  Description of Artificial Sequence: Synthetic oligonucleotide
uaacaacggcgaacaggag

SEQ ID NO: 13346 - RNA, 19 nt, Artificial Sequence
  Description of Artificial Sequence: Synthetic oligonucleotide
ugaacaacggcgaacagga

SEQ ID NO: 13347 - RNA, 19 nt, Artificial Sequence
  Description of Artificial Sequence: Synthetic oligonucleotide
uagaacaacggcgaacagg

SEQ ID NO: 13348 - RNA, 19 nt, Artificial Sequence
  Description of Artificial Sequence: Synthetic oligonucleotide
ucagaacaacggcgaacag

SEQ ID NO: 13349 - RNA, 19 nt, Artificial Sequence
  Description of Artificial Sequence: Synthetic oligonucleotide
uacagaacaacggcgaaca

SEQ ID NO: 13350 - RNA, 19 nt, Artificial Sequence
  Description of Artificial Sequence: Synthetic oligonucleotide
ugacagaacaacggcgaac

SEQ ID NO: 13351 - RNA, 19 nt, Artificial Sequence
  Description of Artificial Sequence: Synthetic oligonucleotide
uagacagaacaacggcgaa

SEQ ID NO: 13352 - RNA, 19 nt, Artificial Sequence
  Description of Artificial Sequence: Synthetic oligonucleotide
ugagacagaacaacggcga

SEQ ID NO: 13353 - RNA, 19 nt, Artificial Sequence
  Description of Artificial Sequence: Synthetic oligonucleotide
ucgagacagaacaacggcg

SEQ ID NO: 13354 - RNA, 19 nt, Artificial Sequence
  Description of Artificial Sequence: Synthetic oligonucleotide
uacgagacagaacaacggc

SEQ ID NO: 13355 - RNA, 19 nt, Artificial Sequence
  Description of Artificial Sequence: Synthetic oligonucleotide
ucacgagacagaacaacgg

SEQ ID NO: 13356 - RNA, 19 nt, Artificial Sequence
  Description of Artificial Sequence: Synthetic oligonucleotide
ugcacgagacagaacaacg

SEQ ID NO: 13357 - RNA, 19 nt, Artificial Sequence
  Description of Artificial Sequence: Synthetic oligonucleotide
uggcacgagacagaacaac

SEQ ID NO: 13358 - RNA, 19 nt, Artificial Sequence
  Description of Artificial Sequence: Synthetic oligonucleotide
ucggcacgagacagaacaa

SEQ ID NO: 13359 - RNA, 19 nt, Artificial Sequence
  Description of Artificial Sequence: Synthetic oligonucleotide
ugcggcacgagacagaaca

SEQ ID NO: 13360 - RNA, 19 nt, Artificial Sequence
  Description of Artificial Sequence: Synthetic oligonucleotide
uggcggcacgagacagaac

SEQ ID NO: 13361 - RNA, 19 nt, Artificial Sequence
  Description of Artificial Sequence: Synthetic oligonucleotide
ucggcggcacgagacagaa

SEQ ID NO: 13362 - RNA, 19 nt, Artificial Sequence
  Description of Artificial Sequence: Synthetic oligonucleotide
ugcggcggcacgagacaga

SEQ ID NO: 13363 - RNA, 19 nt, Artificial Sequence
  Description of Artificial Sequence: Synthetic oligonucleotide
uggcggcggcacgagacag

SEQ ID NO: 13364 - RNA, 19 nt, Artificial Sequence
  Description of Artificial Sequence: Synthetic oligonucleotide
ugggcggcggcacgagaca

SEQ ID NO: 13365 - RNA, 19 nt, Artificial Sequence
  Description of Artificial Sequence: Synthetic oligonucleotide
uagggcggcggcacgagac

SEQ ID NO: 13366 - RNA, 19 nt, Artificial Sequence
  Description of Artificial Sequence: Synthetic oligonucleotide
ucagggcggcggcacgaga

SEQ ID NO: 13367 - RNA, 19 nt, Artificial Sequence
  Description of Artificial Sequence: Synthetic oligonucleotide
uccagggcggcggcacgag

SEQ ID NO: 13368 - RNA, 19 nt, Artificial Sequence
  Description of Artificial Sequence: Synthetic oligonucleotide
ucccagggcggcggcacga

SEQ ID NO: 13369 - RNA, 19 nt, Artificial Sequence
  Description of Artificial Sequence: Synthetic oligonucleotide
ugcccagggcggcggcacg

SEQ ID NO: 13370 - RNA, 19 nt, Artificial Sequence
  Description of Artificial Sequence: Synthetic oligonucleotide
uagcccagggcggcggcac

SEQ ID NO: 13371 - RNA, 19 nt, Artificial Sequence
  Description of Artificial Sequence: Synthetic oligonucleotide
ucagcccagggcggcggca

SEQ ID NO: 13372 - RNA, 19 nt, Artificial Sequence
  Description of Artificial Sequence: Synthetic oligonucleotide
ugcagcccagggcggcggc

SEQ ID NO: 13373 - RNA, 19 nt, Artificial Sequence
  Description of Artificial Sequence: Synthetic oligonucleotide
uugcagcccagggcggcgg

SEQ ID NO: 13374 - RNA, 19 nt, Artificial Sequence
  Description of Artificial Sequence: Synthetic oligonucleotide
uaugcagcccagggcggcg

SEQ ID NO: 13375 - RNA, 19 nt, Artificial Sequence
  Description of Artificial Sequence: Synthetic oligonucleotide
uaaugcagcccagggcggc

SEQ ID NO: 13376 - RNA, 19 nt, Artificial Sequence
  Description of Artificial Sequence: Synthetic oligonucleotide
ucaaugcagcccagggcgg

SEQ ID NO: 13377 - RNA, 19 nt, Artificial Sequence
  Description of Artificial Sequence: Synthetic oligonucleotide
uccaaugcagcccagggcg

SEQ ID NO: 13378 - RNA, 19 nt, Artificial Sequence
  Description of Artificial Sequence: Synthetic oligonucleotide
ucccaaugcagcccagggc

SEQ ID NO: 13379 - RNA, 19 nt, Artificial Sequence
  Description of Artificial Sequence: Synthetic oligonucleotide
uacccaaugcagcccaggg

SEQ ID NO: 13380 - RNA, 19 nt, Artificial Sequence
  Description of Artificial Sequence: Synthetic oligonucleotide
uaacccaaugcagcccagg

SEQ ID NO: 13381 - RNA, 19 nt, Artificial Sequence
  Description of Artificial Sequence: Synthetic oligonucleotide
ucaacccaaugcagcccag

SEQ ID NO: 13382 - RNA, 19 nt, Artificial Sequence
  Description of Artificial Sequence: Synthetic oligonucleotide
uccaacccaaugcagccca

SEQ ID NO: 13383 - RNA, 19 nt, Artificial Sequence
  Description of Artificial Sequence: Synthetic oligonucleotide
uaccaacccaaugcagccc

SEQ ID NO: 13384 - RNA, 19 nt, Artificial Sequence
  Description of Artificial Sequence: Synthetic oligonucleotide
ucaccaacccaaugcagcc

SEQ ID NO: 13385 - RNA, 19 nt, Artificial Sequence
  Description of Artificial Sequence: Synthetic oligonucleotide
uccaccaacccaaugcagc

SEQ ID NO: 13386 - RNA, 19 nt, Artificial Sequence
  Description of Artificial Sequence: Synthetic oligonucleotide
ugccaccaacccaaugcag

SEQ ID NO: 13387 - RNA, 19 nt, Artificial Sequence
  Description of Artificial Sequence: Synthetic oligonucleotide
uggccaccaacccaaugca

SEQ ID NO: 13388 - RNA, 19 nt, Artificial Sequence
  Description of Artificial Sequence: Synthetic oligonucleotide
ugggccaccaacccaaugc

SEQ ID NO: 13389 - RNA, 19 nt, Artificial Sequence
  Description of Artificial Sequence: Synthetic oligonucleotide
uugggccaccaacccaaug

SEQ ID NO: 13390 - RNA, 19 nt, Artificial Sequence
  Description of Artificial Sequence: Synthetic oligonucleotide
ugugggccaccaacccaau

SEQ ID NO: 13391 - RNA, 19 nt, Artificial Sequence
  Description of Artificial Sequence: Synthetic oligonucleotide
ucgugggccaccaacccaa

SEQ ID NO: 13392 - RNA, 19 nt, Artificial Sequence
  Description of Artificial Sequence: Synthetic oligonucleotide
ugcgugggccaccaaccca

SEQ ID NO: 13393 - RNA, 19 nt, Artificial Sequence
  Description of Artificial Sequence: Synthetic oligonucleotide
uggcgugggccaccaaccc

SEQ ID NO: 13394 - RNA, 19 nt, Artificial Sequence
  Description of Artificial Sequence: Synthetic oligonucleotide
ucggcgugggccaccaacc

SEQ ID NO: 13395 - RNA, 19 nt, Artificial Sequence
  Description of Artificial Sequence: Synthetic oligonucleotide
uccggcgugggccaccaac

SEQ ID NO: 13396 - RNA, 19 nt, Artificial Sequence
  Description of Artificial Sequence: Synthetic oligonucleotide
ugccggcgugggccaccaa

SEQ ID NO: 13397 - RNA, 19 nt, Artificial Sequence
  Description of Artificial Sequence: Synthetic oligonucleotide
uggccggcgugggccacca

SEQ ID NO: 13398 - RNA, 19 nt, Artificial Sequence
  Description of Artificial Sequence: Synthetic oligonucleotide
uuggccggcgugggccacc

SEQ ID NO: 13399 - RNA, 19 nt, Artificial Sequence
  Description of Artificial Sequence: Synthetic oligonucleotide
uuuggccggcgugggccac

SEQ ID NO: 13400 - RNA, 19 nt, Artificial Sequence
  Description of Artificial Sequence: Synthetic oligonucleotide
uguuggccggcgugggcca

SEQ ID NO: 13401 - RNA, 19 nt, Artificial Sequence
  Description of Artificial Sequence: Synthetic oligonucleotide
uaguuggccggcgugggcc

SEQ ID NO: 13402 - RNA, 19 nt, Artificial Sequence
  Description of Artificial Sequence: Synthetic oligonucleotide
ugaguuggccggcgugggc

SEQ ID NO: 13403 - RNA, 19 nt, Artificial Sequence
  Description of Artificial Sequence: Synthetic oligonucleotide
uugaguuggccggcguggg

SEQ ID NO: 13404 - RNA, 19 nt, Artificial Sequence
  Description of Artificial Sequence: Synthetic oligonucleotide
ugugaguuggccggcgugg

SEQ ID NO: 13405 - RNA, 19 nt, Artificial Sequence
  Description of Artificial Sequence: Synthetic oligonucleotide
uggugaguuggccggcgug

SEQ ID NO: 13406 - RNA, 19 nt, Artificial Sequence
  Description of Artificial Sequence: Synthetic oligonucleotide
ucggugaguuggccggcgu

SEQ ID NO: 13407 - RNA, 19 nt, Artificial Sequence
  Description of Artificial Sequence: Synthetic oligonucleotide
ugcggugaguuggccggcg

SEQ ID NO: 13408 - RNA, 19 nt, Artificial Sequence
  Description of Artificial Sequence: Synthetic oligonucleotide
uugcggugaguuggccggc

SEQ ID NO: 13409 - RNA, 19 nt, Artificial Sequence
  Description of Artificial Sequence: Synthetic oligonucleotide
ucugcggugaguuggccgg

SEQ ID NO: 13410 - RNA, 19 nt, Artificial Sequence
  Description of Artificial Sequence: Synthetic oligonucleotide
uacugcggugaguuggccg

SEQ ID NO: 13411 - RNA, 19 nt, Artificial Sequence
  Description of Artificial Sequence: Synthetic oligonucleotide
ugacugcggugaguuggcc

SEQ ID NO: 13412 - RNA, 19 nt, Artificial Sequence
  Description of Artificial Sequence: Synthetic oligonucleotide
uagacugcggugaguuggc

SEQ ID NO: 13413 - RNA, 19 nt, Artificial Sequence
  Description of Artificial Sequence: Synthetic oligonucleotide
ucagacugcggugaguugg

SEQ ID NO: 13414 - RNA, 19 nt, Artificial Sequence
  Description of Artificial Sequence: Synthetic oligonucleotide
uccagacugcggugaguug

SEQ ID NO: 13415 - RNA, 19 nt, Artificial Sequence
  Description of Artificial Sequence: Synthetic oligonucleotide
ugccagacugcggugaguu

SEQ ID NO: 13416 - RNA, 19 nt, Artificial Sequence
  Description of Artificial Sequence: Synthetic oligonucleotide
ucgccagacugcggugagu

SEQ ID NO: 13417 - RNA, 19 nt, Artificial Sequence
  Description of Artificial Sequence: Synthetic oligonucleotide
ugcgccagacugcggugag

SEQ ID NO: 13418 - RNA, 19 nt, Artificial Sequence
  Description of Artificial Sequence: Synthetic oligonucleotide
uggcgccagacugcgguga

SEQ ID NO: 13419 - RNA, 19 nt, Artificial Sequence
  Description of Artificial Sequence: Synthetic oligonucleotide
ucggcgccagacugcggug

SEQ ID NO: 13420 - RNA, 19 nt, Artificial Sequence
  Description of Artificial Sequence: Synthetic oligonucleotide
ugcggcgccagacugcggu

SEQ ID NO: 13421 - RNA, 19 nt, Artificial Sequence
  Description of Artificial Sequence: Synthetic oligonucleotide
uggcggcgccagacugcgg

SEQ ID NO: 13422 - RNA, 19 nt, Artificial Sequence
  Description of Artificial Sequence: Synthetic oligonucleotide
ugggcggcgccagacugcg

SEQ ID NO: 13423 - RNA, 19 nt, Artificial Sequence
  Description of Artificial Sequence: Synthetic oligonucleotide
uugggcggcgccagacugc

SEQ ID NO: 13424 - RNA, 19 nt, Artificial Sequence
  Description of Artificial Sequence: Synthetic oligonucleotide
ucugggcggcgccagacug

SEQ ID NO: 13425 - RNA, 19 nt, Artificial Sequence
  Description of Artificial Sequence: Synthetic oligonucleotide
uccugggcggcgccagacu

SEQ ID NO: 13426 - RNA, 19 nt, Artificial Sequence
  Description of Artificial Sequence: Synthetic oligonucleotide
uuccugggcggcgccagac

SEQ ID NO: 13427 - RNA, 19 nt, Artificial Sequence
  Description of Artificial Sequence: Synthetic oligonucleotide
ucuccugggcggcgccaga

SEQ ID NO: 13428 - RNA, 19 nt, Artificial Sequence
  Description of Artificial Sequence: Synthetic oligonucleotide
ugcuccugggcggcgccag

SEQ ID NO: 13429 - RNA, 19 nt, Artificial Sequence
  Description of Artificial Sequence: Synthetic oligonucleotide
uggcuccugggcggcgcca

SEQ ID NO: 13430 - RNA, 19 nt, Artificial Sequence
  Description of Artificial Sequence: Synthetic oligonucleotide
ucggcuccugggcggcgcc

SEQ ID NO: 13431 - RNA, 19 nt, Artificial Sequence
  Description of Artificial Sequence: Synthetic oligonucleotide
ugcggcuccugggcggcgc

SEQ ID NO: 13432 - RNA, 19 nt, Artificial Sequence
  Description of Artificial Sequence: Synthetic oligonucleotide
uggcggcuccugggcggcg

SEQ ID NO: 13433 - RNA, 19 nt, Artificial Sequence
  Description of Artificial Sequence: Synthetic oligonucleotide
ugggcggcuccugggcggc

SEQ ID NO: 13434 - RNA, 19 nt, Artificial Sequence
  Description of Artificial Sequence: Synthetic oligonucleotide
ucgggcggcuccugggcgg

SEQ ID NO: 13435 - RNA, 19 nt, Artificial Sequence
  Description of Artificial Sequence: Synthetic oligonucleotide
ugcgggcggcuccugggcg

SEQ ID NO: 13436 - RNA, 19 nt, Artificial Sequence
  Description of Artificial Sequence: Synthetic oligonucleotide
ucgcgggcggcuccugggc

SEQ ID NO: 13437 - RNA, 19 nt, Artificial Sequence
  Description of Artificial Sequence: Synthetic oligonucleotide
ugcgcgggcggcuccuggg

SEQ ID NO: 13438 - RNA, 19 nt, Artificial Sequence
  Description of Artificial Sequence: Synthetic oligonucleotide
uagcgcgggcggcuccugg

SEQ ID NO: 13439 - RNA, 19 nt, Artificial Sequence
  Description of Artificial Sequence: Synthetic oligonucleotide
ugagcgcgggcggcuccug

SEQ ID NO: 13440 - RNA, 19 nt, Artificial Sequence
  Description of Artificial Sequence: Synthetic oligonucleotide
uggagcgcgggcggcuccu

SEQ ID NO: 13441 - RNA, 19 nt, Artificial Sequence
  Description of Artificial Sequence: Synthetic oligonucleotide
ugggagcgcgggcggcucc

SEQ ID NO: 13442 - RNA, 19 nt, Artificial Sequence
  Description of Artificial Sequence: Synthetic oligonucleotide
uagggagcgcgggcggcuc

SEQ ID NO: 13443 - RNA, 19 nt, Artificial Sequence
  Description of Artificial Sequence: Synthetic oligonucleotide
ucagggagcgcgggcggcu

SEQ ID NO: 13444 - RNA, 19 nt, Artificial Sequence
  Description of Artificial Sequence: Synthetic oligonucleotide
uucagggagcgcgggcggc

SEQ ID NO: 13445 - RNA, 19 nt, Artificial Sequence
  Description of Artificial Sequence: Synthetic oligonucleotide
uuucagggagcgcgggcgg

SEQ ID NO: 13446 - RNA, 19 nt, Artificial Sequence
  Description of Artificial Sequence: Synthetic oligonucleotide
uguucagggagcgcgggcg

SEQ ID NO: 13447 - RNA, 19 nt, Artificial Sequence
  Description of Artificial Sequence: Synthetic oligonucleotide
ugguucagggagcgcgggc

SEQ ID NO: 13448 - RNA, 19 nt, Artificial Sequence
  Description of Artificial Sequence: Synthetic oligonucleotide
uggguucagggagcgcggg

SEQ ID NO: 13449 - RNA, 19 nt, Artificial Sequence
  Description of Artificial Sequence: Synthetic oligonucleotide
uaggguucagggagcgcgg

SEQ ID NO: 13450 - RNA, 19 nt, Artificial Sequence
  Description of Artificial Sequence: Synthetic oligonucleotide
uuaggguucagggagcgcg

SEQ ID NO: 13451 - RNA, 19 nt, Artificial Sequence
  Description of Artificial Sequence: Synthetic oligonucleotide
ucuaggguucagggagcgc

SEQ ID NO: 13452 - RNA, 19 nt, Artificial Sequence
  Description of Artificial Sequence: Synthetic oligonucleotide
uucuaggguucagggagcg

SEQ ID NO: 13453 - RNA, 19 nt, Artificial Sequence
  Description of Artificial Sequence: Synthetic oligonucleotide
uuucuaggguucagggagc

SEQ ID NO: 13454 - RNA, 19 nt, Artificial Sequence
  Description of Artificial Sequence: Synthetic oligonucleotide
uguucuaggguucagggag

SEQ ID NO: 13455 - RNA, 19 nt, Artificial Sequence
  Description of Artificial Sequence: Synthetic oligonucleotide
uaguucuaggguucaggga

SEQ ID NO: 13456 - RNA, 19 nt, Artificial Sequence
  Description of Artificial Sequence: Synthetic oligonucleotide
ucaguucuaggguucaggg

SEQ ID NO: 13457 - RNA, 19 nt, Artificial Sequence
  Description of Artificial Sequence: Synthetic oligonucleotide
uacaguucuaggguucagg

SEQ ID NO: 13458 - RNA, 19 nt, Artificial Sequence
  Description of Artificial Sequence: Synthetic oligonucleotide
ugacaguucuaggguucag

SEQ ID NO: 13459 - RNA, 19 nt, Artificial Sequence
  Description of Artificial Sequence: Synthetic oligonucleotide
uagacaguucuaggguuca

SEQ ID NO: 13460 - RNA, 19 nt, Artificial Sequence
  Description of Artificial Sequence: Synthetic oligonucleotide
uaagacaguucuaggguuc

SEQ ID NO: 13461 - RNA, 19 nt, Artificial Sequence
  Description of Artificial Sequence: Synthetic oligonucleotide
ugaagacaguucuaggguu

SEQ ID NO: 13462 - RNA, 19 nt, Artificial Sequence
  Description of Artificial Sequence: Synthetic oligonucleotide
ucgaagacaguucuagggu

SEQ ID NO: 13463 - RNA, 19 nt, Artificial Sequence
  Description of Artificial Sequence: Synthetic oligonucleotide
uucgaagacaguucuaggg

SEQ ID NO: 13464 - RNA, 19 nt, Artificial Sequence
  Description of Artificial Sequence: Synthetic oligonucleotide
ugucgaagacaguucuagg

SEQ ID NO: 13465 - RNA, 19 nt, Artificial Sequence
  Description of Artificial Sequence: Synthetic oligonucleotide
uagucgaagacaguucuag

SEQ ID NO: 13466 - RNA, 19 nt, Artificial Sequence
  Description of Artificial Sequence: Synthetic oligonucleotide
ugagucgaagacaguucua

SEQ ID NO: 13467 - RNA, 19 nt, Artificial Sequence
  Description of Artificial Sequence: Synthetic oligonucleotide
uggagucgaagacaguucu

SEQ ID NO: 13468 - RNA, 19 nt, Artificial Sequence
  Description of Artificial Sequence: Synthetic oligonucleotide
ucggagucgaagacaguuc

SEQ ID NO: 13469 - RNA, 19 nt, Artificial Sequence
  Description of Artificial Sequence: Synthetic oligonucleotide
uccggagucgaagacaguu

SEQ ID NO: 13470 - RNA, 19 nt, Artificial Sequence
  Description of Artificial Sequence: Synthetic oligonucleotide
ucccggagucgaagacagu

SEQ ID NO: 13471 - RNA, 19 nt, Artificial Sequence
  Description of Artificial Sequence: Synthetic oligonucleotide
uccccggagucgaagacag

SEQ ID NO: 13472 - RNA, 19 nt, Artificial Sequence
  Description of Artificial Sequence: Synthetic oligonucleotide
ugccccggagucgaagaca

SEQ ID NO: 13473 - RNA, 19 nt, Artificial Sequence
  Description of Artificial Sequence: Synthetic oligonucleotide
uggccccggagucgaagac

SEQ ID NO: 13474 - RNA, 19 nt, Artificial Sequence
  Description of Artificial Sequence: Synthetic oligonucleotide
ugggccccggagucgaaga

SEQ ID NO: 13475 - RNA, 19 nt, Artificial Sequence
  Description of Artificial Sequence: Synthetic oligonucleotide
uggggccccggagucgaag

SEQ ID NO: 13476 - RNA, 19 nt, Artificial Sequence
  Description of Artificial Sequence: Synthetic oligonucleotide
ucggggccccggagucgaa

SEQ ID NO: 13477 - RNA, 19 nt, Artificial Sequence
  Description of Artificial Sequence: Synthetic oligonucleotide
uacggggccccggagucga

SEQ ID NO: 13478 - RNA, 19 nt, Artificial Sequence
  Description of Artificial Sequence: Synthetic oligonucleotide
uaacggggccccggagucg

SEQ ID NO: 13479 - RNA, 19 nt, Artificial Sequence
  Description of Artificial Sequence: Synthetic oligonucleotide
ucaacggggccccggaguc

SEQ ID NO: 13480 - RNA, 19 nt, Artificial Sequence
  Description of Artificial Sequence: Synthetic oligonucleotide
uccaacggggccccggagu

SEQ ID NO: 13481 - RNA, 19 nt, Artificial Sequence
  Description of Artificial Sequence: Synthetic oligonucleotide
uuccaacggggccccggag

SEQ ID NO: 13482 - RNA, 19 nt, Artificial Sequence
  Description of Artificial Sequence: Synthetic oligonucleotide
uuuccaacggggccccgga

SEQ ID NO: 13483 - RNA, 19 nt, Artificial Sequence
  Description of Artificial Sequence: Synthetic oligonucleotide
ucuuccaacggggccccgg

SEQ ID NO: 13484 - RNA, 19 nt, Artificial Sequence
  Description of Artificial Sequence: Synthetic oligonucleotide
uucuuccaacggggccccg

SEQ ID NO: 13485 - RNA, 19 nt, Artificial Sequence
  Description of Artificial Sequence: Synthetic oligonucleotide
ugucuuccaacggggcccc

SEQ ID NO: 13486 - RNA, 19 nt, Artificial Sequence
  Description of Artificial Sequence: Synthetic oligonucleotide
uagucuuccaacggggccc

SEQ ID NO: 13487 - RNA, 19 nt, Artificial Sequence
  Description of Artificial Sequence: Synthetic oligonucleotide
ucagucuuccaacggggcc

SEQ ID NO: 13488 - RNA, 19 nt, Artificial Sequence
  Description of Artificial Sequence: Synthetic oligonucleotide
uucagucuuccaacggggc

SEQ ID NO: 13489 - RNA, 19 nt, Artificial Sequence
  Description of Artificial Sequence: Synthetic oligonucleotide
ucucagucuuccaacgggg

SEQ ID NO: 13490 - RNA, 19 nt, Artificial Sequence
  Description of Artificial Sequence: Synthetic oligonucleotide
uacucagucuuccaacggg

SEQ ID NO: 13491 - RNA, 19 nt, Artificial Sequence
  Description of Artificial Sequence: Synthetic oligonucleotide
ucacucagucuuccaacgg

SEQ ID NO: 13492 - RNA, 19 nt, Artificial Sequence
  Description of Artificial Sequence: Synthetic oligonucleotide
ugcacucagucuuccaacg

SEQ ID NO: 13493 - RNA, 19 nt, Artificial Sequence
  Description of Artificial Sequence: Synthetic oligonucleotide
uggcacucagucuuccaac

SEQ ID NO: 13494 - RNA, 19 nt, Artificial Sequence
  Description of Artificial Sequence: Synthetic oligonucleotide
ugggcacucagucuuccaa

SEQ ID NO: 13495 - RNA, 19 nt, Artificial Sequence
  Description of Artificial Sequence: Synthetic oligonucleotide
ucgggcacucagucuucca

SEQ ID NO: 13496 - RNA, 19 nt, Artificial Sequence
  Description of Artificial Sequence: Synthetic oligonucleotide
uccgggcacucagucuucc

SEQ ID NO: 13497 - RNA, 19 nt, Artificial Sequence
  Description of Artificial Sequence: Synthetic oligonucleotide
ucccgggcacucagucuuc

SEQ ID NO: 13498 - RNA, 19 nt, Artificial Sequence
  Description of Artificial Sequence: Synthetic oligonucleotide
uccccgggcacucagucuu

SEQ ID NO: 13499 - RNA, 19 nt, Artificial Sequence
  Description of Artificial Sequence: Synthetic oligonucleotide
ugccccgggcacucagucu

SEQ ID NO: 13500 - RNA, 19 nt, Artificial Sequence
  Description of Artificial Sequence: Synthetic oligonucleotide
uugccccgggcacucaguc

SEQ ID NO: 13501 - RNA, 19 nt, Artificial Sequence
  Description of Artificial Sequence: Synthetic oligonucleotide
ugugccccgggcacucagu

SEQ ID NO: 13502 - RNA, 19 nt, Artificial Sequence
  Description of Artificial Sequence: Synthetic oligonucleotide
ucgugccccgggcacucag

SEQ ID NO: 13503 - RNA, 19 nt, Artificial Sequence
  Description of Artificial Sequence: Synthetic oligonucleotide
uccgugccccgggcacuca

SEQ ID NO: 13504 - RNA, 19 nt, Artificial Sequence
  Description of Artificial Sequence: Synthetic oligonucleotide
ugccgugccccgggcacuc

SEQ ID NO: 13505 - RNA, 19 nt, Artificial Sequence
  Description of Artificial Sequence: Synthetic oligonucleotide
uugccgugccccgggcacu

SEQ ID NO: 13506 - RNA, 19 nt, Artificial Sequence
  Description of Artificial Sequence: Synthetic oligonucleotide
ugugccgugccccgggcac

SEQ ID NO: 13507 - RNA, 19 nt, Artificial Sequence
  Description of Artificial Sequence: Synthetic oligonucleotide
uugugccgugccccgggca

SEQ ID NO: 13508 - RNA, 19 nt, Artificial Sequence
  Description of Artificial Sequence: Synthetic oligonucleotide
ucugugccgugccccgggc

SEQ ID NO: 13509 - RNA, 19 nt, Artificial Sequence
  Description of Artificial Sequence: Synthetic oligonucleotide
uucugugccgugccccggg

SEQ ID NO: 13510 - RNA, 19 nt, Artificial Sequence
  Description of Artificial Sequence: Synthetic oligonucleotide
uuucugugccgugccccgg

SEQ ID NO: 13511 - RNA, 19 nt, Artificial Sequence
  Description of Artificial Sequence: Synthetic oligonucleotide
ucuucugugccgugccccg

SEQ ID NO: 13512 - RNA, 19 nt, Artificial Sequence
  Description of Artificial Sequence: Synthetic oligonucleotide
ugcuucugugccgugcccc

SEQ ID NO: 13513 - RNA, 19 nt, Artificial Sequence
  Description of Artificial Sequence: Synthetic oligonucleotide
uggcuucugugccgugccc

SEQ ID NO: 13514 - RNA, 19 nt, Artificial Sequence
  Description of Artificial Sequence: Synthetic oligonucleotide
ucggcuucugugccgugcc

SEQ ID NO: 13515 - RNA, 19 nt, Artificial Sequence
  Description of Artificial Sequence: Synthetic oligonucleotide
ugcggcuucugugccgugc

SEQ ID NO: 13516 - RNA, 19 nt, Artificial Sequence
  Description of Artificial Sequence: Synthetic oligonucleotide
ucgcggcuucugugccgug

SEQ ID NO: 13517 - RNA, 19 nt, Artificial Sequence
  Description of Artificial Sequence: Synthetic oligonucleotide
ugcgcggcuucugugccgu

SEQ ID NO: 13518 - RNA, 19 nt, Artificial Sequence
  Description of Artificial Sequence: Synthetic oligonucleotide
uggcgcggcuucugugccg

SEQ ID NO: 13519 - RNA, 19 nt, Artificial Sequence
  Description of Artificial Sequence: Synthetic oligonucleotide
ugggcgcggcuucugugcc

SEQ ID NO: 13520 - RNA, 19 nt, Artificial Sequence
  Description of Artificial Sequence: Synthetic oligonucleotide
uugggcgcggcuucugugc

SEQ ID NO: 13521 - RNA, 19 nt, Artificial Sequence
  Description of Artificial Sequence: Synthetic oligonucleotide
ugugggcgcggcuucugug

SEQ ID NO: 13522 - RNA, 19 nt, Artificial Sequence
  Description of Artificial Sequence: Synthetic oligonucleotide
uggugggcgcggcuucugu

SEQ ID NO: 13523 - RNA, 19 nt, Artificial Sequence
  Description of Artificial Sequence: Synthetic oligonucleotide
ucggugggcgcggcuucug

SEQ ID NO: 13524 - RNA, 19 nt, Artificial Sequence
  Description of Artificial Sequence: Synthetic oligonucleotide
ugcggugggcgcggcuucu

SEQ ID NO: 13525 - RNA, 19 nt, Artificial Sequence
  Description of Artificial Sequence: Synthetic oligonucleotide
uggcggugggcgcggcuuc

SEQ ID NO: 13526 - RNA, 19 nt, Artificial Sequence
  Description of Artificial Sequence: Synthetic oligonucleotide
uaggcggugggcgcggcuu

SEQ ID NO: 13527 - RNA, 19 nt, Artificial Sequence
  Description of Artificial Sequence: Synthetic oligonucleotide
ucaggcggugggcgcggcu

SEQ ID NO: 13528 - RNA, 19 nt, Artificial Sequence
  Description of Artificial Sequence: Synthetic oligonucleotide
ugcaggcggugggcgcggc

SEQ ID NO: 13529 - RNA, 19 nt, Artificial Sequence
  Description of Artificial Sequence: Synthetic oligonucleotide
uggcaggcggugggcgcgg

SEQ ID NO: 13530 - RNA, 19 nt, Artificial Sequence
  Description of Artificial Sequence: Synthetic oligonucleotide
uuggcaggcggugggcgcg

SEQ ID NO: 13531 - RNA, 19 nt, Artificial Sequence
  Description of Artificial Sequence: Synthetic oligonucleotide
ucuggcaggcggugggcgc

SEQ ID NO: 13532 - RNA, 19 nt, Artificial Sequence
  Description of Artificial Sequence: Synthetic oligonucleotide
uacuggcaggcggugggcg

SEQ ID NO: 13533 - RNA, 19 nt, Artificial Sequence
  Description of Artificial Sequence: Synthetic oligonucleotide
uaacuggcaggcggugggc

SEQ ID NO: 13534 - RNA, 19 nt, Artificial Sequence
  Description of Artificial Sequence: Synthetic oligonucleotide
ugaacuggcaggcgguggg

SEQ ID NO: 13535 - RNA, 19 nt, Artificial Sequence
  Description of Artificial Sequence: Synthetic oligonucleotide
uugaacuggcaggcggugg

SEQ ID NO: 13536 - RNA, 19 nt, Artificial Sequence
  Description of Artificial Sequence: Synthetic oligonucleotide
ugugaacuggcaggcggug

SEQ ID NO: 13537 - RNA, 19 nt, Artificial Sequence
  Description of Artificial Sequence: Synthetic oligonucleotide
uugugaacuggcaggcggu

SEQ ID NO: 13538 - RNA, 19 nt, Artificial Sequence
  Description of Artificial Sequence: Synthetic oligonucleotide
uuugugaacuggcaggcgg

SEQ ID NO: 13539 - RNA, 19 nt, Artificial Sequence
  Description of Artificial Sequence: Synthetic oligonucleotide
uguugugaacuggcaggcg

SEQ ID NO: 13540 - RNA, 19 nt, Artificial Sequence
  Description of Artificial Sequence: Synthetic oligonucleotide
ugguugugaacuggcaggc

SEQ ID NO: 13541 - RNA, 19 nt, Artificial Sequence
  Description of Artificial Sequence: Synthetic oligonucleotide
ucgguugugaacuggcagg

SEQ ID NO: 13542 - RNA, 19 nt, Artificial Sequence
  Description of Artificial Sequence: Synthetic oligonucleotide
ugcgguugugaacuggcag

SEQ ID NO: 13543 - RNA, 19 nt, Artificial Sequence
  Description of Artificial Sequence: Synthetic oligonucleotide
uagcgguugugaacuggca

SEQ ID NO: 13544 - RNA, 19 nt, Artificial Sequence
  Description of Artificial Sequence: Synthetic oligonucleotide
ugagcgguugugaacuggc

SEQ ID NO: 13545 - RNA, 19 nt, Artificial Sequence
  Description of Artificial Sequence: Synthetic oligonucleotide
uggagcgguugugaacugg

SEQ ID NO: 13546 - RNA, 19 nt, Artificial Sequence
  Description of Artificial Sequence: Synthetic oligonucleotide
ucggagcgguugugaacug

SEQ ID NO: 13547 - RNA, 19 nt, Artificial Sequence
  Description of Artificial Sequence: Synthetic oligonucleotide
uucggagcgguugugaacu

SEQ ID NO: 13548 - RNA, 19 nt, Artificial Sequence
  Description of Artificial Sequence: Synthetic oligonucleotide
ucucggagcgguugugaac

SEQ ID NO: 13549 - RNA, 19 nt, Artificial Sequence
  Description of Artificial Sequence: Synthetic oligonucleotide
ugcucggagcgguugugaa

SEQ ID NO: 13550 - RNA, 19 nt, Artificial Sequence
  Description of Artificial Sequence: Synthetic oligonucleotide
ucgcucggagcgguuguga

SEQ ID NO: 13551 - RNA, 19 nt, Artificial Sequence
  Description of Artificial Sequence: Synthetic oligonucleotide
uacgcucggagcgguugug

SEQ ID NO: 13552 - RNA, 19 nt, Artificial Sequence
  Description of Artificial Sequence: Synthetic oligonucleotide
ucacgcucggagcgguugu

SEQ ID NO: 13553 - RNA, 19 nt, Artificial Sequence
  Description of Artificial Sequence: Synthetic oligonucleotide
uccacgcucggagcgguug

SEQ ID NO: 13554 - RNA, 19 nt, Artificial Sequence
  Description of Artificial Sequence: Synthetic oligonucleotide
ucccacgcucggagcgguu

SEQ ID NO: 13555 - RNA, 19 nt, Artificial Sequence
  Description of Artificial Sequence: Synthetic oligonucleotide
uacccacgcucggagcggu

SEQ ID NO: 13556 - RNA, 19 nt, Artificial Sequence
  Description of Artificial Sequence: Synthetic oligonucleotide
ugacccacgcucggagcgg

SEQ ID NO: 13557 - RNA, 19 nt, Artificial Sequence
  Description of Artificial Sequence: Synthetic oligonucleotide
uagacccacgcucggagcg

SEQ ID NO: 13558 - RNA, 19 nt, Artificial Sequence
  Description of Artificial Sequence: Synthetic oligonucleotide
ugagacccacgcucggagc

SEQ ID NO: 13559 - RNA, 19 nt, Artificial Sequence
  Description of Artificial Sequence: Synthetic oligonucleotide
uggagacccacgcucggag

SEQ ID NO: 13560 - RNA, 19 nt, Artificial Sequence
  Description of Artificial Sequence: Synthetic oligonucleotide
ucggagacccacgcucgga

SEQ ID NO: 13561 - RNA, 19 nt, Artificial Sequence
  Description of Artificial Sequence: Synthetic oligonucleotide
ugcggagacccacgcucgg

SEQ ID NO: 13562 - RNA, 19 nt, Artificial Sequence
  Description of Artificial Sequence: Synthetic oligonucleotide
uggcggagacccacgcucg

SEQ ID NO: 13563 - RNA, 19 nt, Artificial Sequence
  Description of Artificial Sequence: Synthetic oligonucleotide
ugggcggagacccacgcuc

SEQ ID NO: 13564 - RNA, 19 nt, Artificial Sequence
  Description of Artificial Sequence: Synthetic oligonucleotide
uugggcggagacccacgcu

SEQ ID NO: 13565 - RNA, 19 nt, Artificial Sequence
  Description of Artificial Sequence: Synthetic oligonucleotide
ucugggcggagacccacgc

SEQ ID NO: 13566 - RNA, 19 nt, Artificial Sequence
  Description of Artificial Sequence: Synthetic oligonucleotide
ugcugggcggagacccacg

SEQ ID NO: 13567 - RNA, 19 nt, Artificial Sequence
  Description of Artificial Sequence: Synthetic oligonucleotide
uagcugggcggagacccac

SEQ ID NO: 13568 - RNA, 19 nt, Artificial Sequence
  Description of Artificial Sequence: Synthetic oligonucleotide
ugagcugggcggagaccca

SEQ ID NO: 13569 - RNA, 19 nt, Artificial Sequence
  Description of Artificial Sequence: Synthetic oligonucleotide
uggagcugggcggagaccc

SEQ ID NO: 13570 - RNA, 19 nt, Artificial Sequence
  Description of Artificial Sequence: Synthetic oligonucleotide
uuggagcugggcggagacc

SEQ ID NO: 13571 - RNA, 19 nt, Artificial Sequence
  Description of Artificial Sequence: Synthetic oligonucleotide
ucuggagcugggcggagac

SEQ ID NO: 13572 - RNA, 19 nt, Artificial Sequence
  Description of Artificial Sequence: Synthetic oligonucleotide
uacuggagcugggcggaga

SEQ ID NO: 13573 - RNA, 19 nt, Artificial Sequence
  Description of Artificial Sequence: Synthetic oligonucleotide
ugacuggagcugggcggag

SEQ ID NO: 13574 - RNA, 19 nt, Artificial Sequence
  Description of Artificial Sequence: Synthetic oligonucleotide
uggacuggagcugggcgga

SEQ ID NO: 13575 - RNA, 19 nt, Artificial Sequence
  Description of Artificial Sequence: Synthetic oligonucleotide
uaggacuggagcugggcgg

SEQ ID NO: 13576 - RNA, 19 nt, Artificial Sequence
  Description of Artificial Sequence: Synthetic oligonucleotide
ucaggacuggagcugggcg

SEQ ID NO: 13577 - RNA, 19 nt, Artificial Sequence
  Description of Artificial Sequence: Synthetic oligonucleotide
uacaggacuggagcugggc

SEQ ID NO: 13578 - RNA, 19 nt, Artificial Sequence
  Description of Artificial Sequence: Synthetic oligonucleotide
ucacaggacuggagcuggg

SEQ ID NO: 13579 - RNA, 19 nt, Artificial Sequence
  Description of Artificial Sequence: Synthetic oligonucleotide
uucacaggacuggagcugg

SEQ ID NO: 13580 - RNA, 19 nt, Artificial Sequence
  Description of Artificial Sequence: Synthetic oligonucleotide
uaucacaggacuggagcug

SEQ ID NO: 13581 - RNA, 19 nt, Artificial Sequence
  Description of Artificial Sequence: Synthetic oligonucleotide
ugaucacaggacuggagcu

SEQ ID NO: 13582 - RNA, 19 nt, Artificial Sequence
  Description of Artificial Sequence: Synthetic oligonucleotide
uggaucacaggacuggagc

SEQ ID NO: 13583 - RNA, 19 nt, Artificial Sequence
  Description of Artificial Sequence: Synthetic oligonucleotide
ucggaucacaggacuggag

SEQ ID NO: 13584 - RNA, 19 nt, Artificial Sequence
  Description of Artificial Sequence: Synthetic oligonucleotide
uccggaucacaggacugga

SEQ ID NO: 13585 - RNA, 19 nt, Artificial Sequence
  Description of Artificial Sequence: Synthetic oligonucleotide
ucccggaucacaggacugg

SEQ ID NO: 13586 - RNA, 19 nt, Artificial Sequence
  Description of Artificial Sequence: Synthetic oligonucleotide
ugcccggaucacaggacug

SEQ ID NO: 13587 - RNA, 19 nt, Artificial Sequence
  Description of Artificial Sequence: Synthetic oligonucleotide
uggcccggaucacaggacu

SEQ ID NO: 13588 - RNA, 19 nt, Artificial Sequence
  Description of Artificial Sequence: Synthetic oligonucleotide
ugggcccggaucacaggac

SEQ ID NO: 13589 - RNA, 19 nt, Artificial Sequence
  Description of Artificial Sequence: Synthetic oligonucleotide
ucgggcccggaucacagga

SEQ ID NO: 13590 - RNA, 19 nt, Artificial Sequence
  Description of Artificial Sequence: Synthetic oligonucleotide
ugcgggcccggaucacagg

SEQ ID NO: 13591 - RNA, 19 nt, Artificial Sequence
  Description of Artificial Sequence: Synthetic oligonucleotide
uggcgggcccggaucacag

SEQ ID NO: 13592 - RNA, 19 nt, Artificial Sequence
  Description of Artificial Sequence: Synthetic oligonucleotide
ugggcgggcccggaucaca

SEQ ID NO: 13593 - RNA, 19 nt, Artificial Sequence
  Description of Artificial Sequence: Synthetic oligonucleotide
uggggcgggcccggaucac

SEQ ID NO: 13594 - RNA, 19 nt, Artificial Sequence
  Description of Artificial Sequence: Synthetic oligonucleotide
ugggggcgggcccggauca

SEQ ID NO: 13595 - RNA, 19 nt, Artificial Sequence
  Description of Artificial Sequence: Synthetic oligonucleotide
uagggggcgggcccggauc

SEQ ID NO: 13596 - RNA, 19 nt, Artificial Sequence
  Description of Artificial Sequence: Synthetic oligonucleotide
uuagggggcgggcccggau

SEQ ID NO: 13597 - RNA, 19 nt, Artificial Sequence
  Description of Artificial Sequence: Synthetic oligonucleotide
ucuagggggcgggcccgga

SEQ ID NO: 13598 - RNA, 19 nt, Artificial Sequence
  Description of Artificial Sequence: Synthetic oligonucleotide
ugcuagggggcgggcccgg

SEQ ID NO: 13599 - RNA, 19 nt, Artificial Sequence
  Description of Artificial Sequence: Synthetic oligonucleotide
ucgcuagggggcgggcccg

SEQ ID NO: 13600 - RNA, 19 nt, Artificial Sequence
  Description of Artificial Sequence: Synthetic oligonucleotide
uccgcuagggggcgggccc

SEQ ID NO: 13601 - RNA, 19 nt, Artificial Sequence
  Description of Artificial Sequence: Synthetic oligonucleotide
ugccgcuagggggcgggcc

SEQ ID NO: 13602 - RNA, 19 nt, Artificial Sequence
  Description of Artificial Sequence: Synthetic oligonucleotide
uggccgcuagggggcgggc

SEQ ID NO: 13603 - RNA, 19 nt, Artificial Sequence
  Description of Artificial Sequence: Synthetic oligonucleotide
ucggccgcuagggggcggg

SEQ ID NO: 13604 - RNA, 19 nt, Artificial Sequence
  Description of Artificial Sequence: Synthetic oligonucleotide
uccggccgcuagggggcgg

SEQ ID NO: 13605 - RNA, 19 nt, Artificial Sequence
  Description of Artificial Sequence: Synthetic oligonucleotide
ucccggccgcuagggggcg

SEQ ID NO: 13606 - RNA, 19 nt, Artificial Sequence
  Description of Artificial Sequence: Synthetic oligonucleotide
uccccggccgcuagggggc

SEQ ID NO: 13607 - RNA, 19 nt, Artificial Sequence
  Description of Artificial Sequence: Synthetic oligonucleotide
uuccccggccgcuaggggg

SEQ ID NO: 13608 - RNA, 19 nt, Artificial Sequence
  Description of Artificial Sequence: Synthetic oligonucleotide
ucuccccggccgcuagggg

SEQ ID NO: 13609 - RNA, 19 nt, Artificial Sequence
  Description of Artificial Sequence: Synthetic oligonucleotide
uccuccccggccgcuaggg

SEQ ID NO: 13610 - RNA, 19 nt, Artificial Sequence
  Description of Artificial Sequence: Synthetic oligonucleotide
ucccuccccggccgcuagg

SEQ ID NO: 13611 - RNA, 19 nt, Artificial Sequence
  Description of Artificial Sequence: Synthetic oligonucleotide
uucccuccccggccgcuag

SEQ ID NO: 13612 - RNA, 19 nt, Artificial Sequence
  Description of Artificial Sequence: Synthetic oligonucleotide
ucucccuccccggccgcua

SEQ ID NO: 13613 - RNA, 19 nt, Artificial Sequence
  Description of Artificial Sequence: Synthetic oligonucleotide
uccucccuccccggccgcu

SEQ ID NO: 13614 - RNA, 19 nt, Artificial Sequence
  Description of Artificial Sequence: Synthetic oligonucleotide
ucccucccuccccggccgc

SEQ ID NO: 13615 - RNA, 19 nt, Artificial Sequence
  Description of Artificial Sequence: Synthetic oligonucleotide
uccccucccuccccggccg

SEQ ID NO: 13616 - RNA, 19 nt, Artificial Sequence
  Description of Artificial Sequence: Synthetic oligonucleotide
ugccccucccuccccggcc

SEQ ID NO: 13617 - RNA, 19 nt, Artificial Sequence
  Description of Artificial Sequence: Synthetic oligonucleotide
uggccccucccuccccggc

SEQ ID NO: 13618 - RNA, 19 nt, Artificial Sequence
  Description of Artificial Sequence: Synthetic oligonucleotide
ucggccccucccuccccgg

SEQ ID NO: 13619 - RNA, 19 nt, Artificial Sequence
  Description of Artificial Sequence: Synthetic oligonucleotide
uccggccccucccuccccg

SEQ ID NO: 13620 - RNA, 19 nt, Artificial Sequence
  Description of Artificial Sequence: Synthetic oligonucleotide
ucccggccccucccucccc

SEQ ID NO: 13621 - RNA, 19 nt, Artificial Sequence
  Description of Artificial Sequence: Synthetic oligonucleotide
uacccggccccucccuccc

SEQ ID NO: 13622 - RNA, 19 nt, Artificial Sequence
  Description of Artificial Sequence: Synthetic oligonucleotide
ugacccggccccucccucc

SEQ ID NO: 13623 - RNA, 19 nt, Artificial Sequence
  Description of Artificial Sequence: Synthetic oligonucleotide
uggacccggccccucccuc

SEQ ID NO: 13624 - RNA, 19 nt, Artificial Sequence
  Description of Artificial Sequence: Synthetic oligonucleotide
ucggacccggccccucccu

SEQ ID NO: 13625 - RNA, 19 nt, Artificial Sequence
  Description of Artificial Sequence: Synthetic oligonucleotide
ugcggacccggccccuccc

SEQ ID NO: 13626 - RNA, 19 nt, Artificial Sequence
  Description of Artificial Sequence: Synthetic oligonucleotide
ucgcggacccggccccucc

SEQ ID NO: 13627 - RNA, 19 nt, Artificial Sequence
  Description of Artificial Sequence: Synthetic oligonucleotide
uccgcggacccggccccuc

SEQ ID NO: 13628 - RNA, 19 nt, Artificial Sequence
  Description of Artificial Sequence: Synthetic oligonucleotide
ugccgcggacccggccccu

SEQ ID NO: 13629 - RNA, 19 nt, Artificial Sequence
  Description of Artificial Sequence: Synthetic oligonucleotide
uggccgcggacccggcccc

SEQ ID NO: 13630 - RNA, 19 nt, Artificial Sequence
  Description of Artificial Sequence: Synthetic oligonucleotide
ucggccgcggacccggccc

SEQ ID NO: 13631 - RNA, 19 nt, Artificial Sequence
  Description of Artificial Sequence: Synthetic oligonucleotide
uccggccgcggacccggcc

SEQ ID NO: 13632 - RNA, 19 nt, Artificial Sequence
  Description of Artificial Sequence: Synthetic oligonucleotide
ugccggccgcggacccggc

SEQ ID NO: 13633 - RNA, 19 nt, Artificial Sequence
  Description of Artificial Sequence: Synthetic oligonucleotide
ucgccggccgcggacccgg

SEQ ID NO: 13634 - RNA, 19 nt, Artificial Sequence
  Description of Artificial Sequence: Synthetic oligonucleotide
uucgccggccgcggacccg

SEQ ID NO: 13635 - RNA, 19 nt, Artificial Sequence
  Description of Artificial Sequence: Synthetic oligonucleotide
uuucgccggccgcggaccc

SEQ ID NO: 13636 - RNA, 19 nt, Artificial Sequence
  Description of Artificial Sequence: Synthetic oligonucleotide
uguucgccggccgcggacc

SEQ ID NO: 13637 - RNA, 19 nt, Artificial Sequence
  Description of Artificial Sequence: Synthetic oligonucleotide
ucguucgccggccgcggac

SEQ ID NO: 13638 - RNA, 19 nt, Artificial Sequence
  Description of Artificial Sequence: Synthetic oligonucleotide
uccguucgccggccgcgga

SEQ ID NO: 13639 - RNA, 19 nt, Artificial Sequence
  Description of Artificial Sequence: Synthetic oligonucleotide
ucccguucgccggccgcgg

SEQ ID NO: 13640 - RNA, 19 nt, Artificial Sequence
  Description of Artificial Sequence: Synthetic oligonucleotide
uccccguucgccggccgcg

SEQ ID NO: 13641 - RNA, 19 nt, Artificial Sequence
  Description of Artificial Sequence: Synthetic oligonucleotide
ugccccguucgccggccgc

SEQ ID NO: 13642 - RNA, 19 nt, Artificial Sequence
  Description of Artificial Sequence: Synthetic oligonucleotide
uagccccguucgccggccg

SEQ ID NO: 13643 - RNA, 19 nt, Artificial Sequence
  Description of Artificial Sequence: Synthetic oligonucleotide
ugagccccguucgccggcc

SEQ ID NO: 13644 - RNA, 19 nt, Artificial Sequence
  Description of Artificial Sequence: Synthetic oligonucleotide
ucgagccccguucgccggc

SEQ ID NO: 13645 - RNA, 19 nt, Artificial Sequence
  Description of Artificial Sequence: Synthetic oligonucleotide
uucgagccccguucgccgg

SEQ ID NO: 13646 - RNA, 19 nt, Artificial Sequence
  Description of Artificial Sequence: Synthetic oligonucleotide
uuucgagccccguucgccg

SEQ ID NO: 13647 - RNA, 19 nt, Artificial Sequence
  Description of Artificial Sequence: Synthetic oligonucleotide
ucuucgagccccguucgcc

SEQ ID NO: 13648 - RNA, 19 nt, Artificial Sequence
  Description of Artificial Sequence: Synthetic oligonucleotide
uccuucgagccccguucgc

SEQ ID NO: 13649 - RNA, 19 nt, Artificial Sequence
  Description of Artificial Sequence: Synthetic oligonucleotide
ucccuucgagccccguucg

SEQ ID NO: 13650 - RNA, 19 nt, Artificial Sequence
  Description of Artificial Sequence: Synthetic oligonucleotide
uacccuucgagccccguuc

SEQ ID NO: 13651 - RNA, 19 nt, Artificial Sequence
  Description of Artificial Sequence: Synthetic oligonucleotide
ugacccuucgagccccguu

SEQ ID NO: 13652 - RNA, 19 nt, Artificial Sequence
  Description of Artificial Sequence: Synthetic oligonucleotide
uggacccuucgagccccgu

SEQ ID NO: 13653 - RNA, 19 nt, Artificial Sequence
  Description of Artificial Sequence: Synthetic oligonucleotide
uaggacccuucgagccccg

SEQ ID NO: 13654 - RNA, 19 nt, Artificial Sequence
  Description of Artificial Sequence: Synthetic oligonucleotide
uaaggacccuucgagcccc

SEQ ID NO: 13655 - RNA, 19 nt, Artificial Sequence
  Description of Artificial Sequence: Synthetic oligonucleotide
ucaaggacccuucgagccc

SEQ ID NO: 13656 - RNA, 19 nt, Artificial Sequence
  Description of Artificial Sequence: Synthetic oligonucleotide
uacaaggacccuucgagcc

SEQ ID NO: 13657 - RNA, 19 nt, Artificial Sequence
  Description of Artificial Sequence: Synthetic oligonucleotide
uuacaaggacccuucgagc

SEQ ID NO: 13658 - RNA, 19 nt, Artificial Sequence
  Description of Artificial Sequence: Synthetic oligonucleotide
ucuacaaggacccuucgag

SEQ ID NO: 13659 - RNA, 19 nt, Artificial Sequence
  Description of Artificial Sequence: Synthetic oligonucleotide
ugcuacaaggacccuucga

SEQ ID NO: 13660 - RNA, 19 nt, Artificial Sequence
  Description of Artificial Sequence: Synthetic oligonucleotide
uggcuacaaggacccuucg

SEQ ID NO: 13661 - RNA, 19 nt, Artificial Sequence
  Description of Artificial Sequence: Synthetic oligonucleotide
ucggcuacaaggacccuuc

SEQ ID NO: 13662 - RNA, 19 nt, Artificial Sequence
  Description of Artificial Sequence: Synthetic oligonucleotide
uccggcuacaaggacccuu

SEQ ID NO: 13663 - RNA, 19 nt, Artificial Sequence
  Description of Artificial Sequence: Synthetic oligonucleotide
ucccggcuacaaggacccu

SEQ ID NO: 13664 - RNA, 19 nt, Artificial Sequence
  Description of Artificial Sequence: Synthetic oligonucleotide
uucccggcuacaaggaccc

SEQ ID NO: 13665 - RNA, 19 nt, Artificial Sequence
  Description of Artificial Sequence: Synthetic oligonucleotide
uuucccggcuacaaggacc

SEQ ID NO: 13666 - RNA, 19 nt, Artificial Sequence
  Description of Artificial Sequence: Synthetic oligonucleotide
uauucccggcuacaaggac

SEQ ID NO: 13667 - RNA, 19 nt, Artificial Sequence
  Description of Artificial Sequence: Synthetic oligonucleotide
ucauucccggcuacaagga

SEQ ID NO: 13668 - RNA, 19 nt, Artificial Sequence
  Description of Artificial Sequence: Synthetic oligonucleotide
ugcauucccggcuacaagg

SEQ ID NO: 13669 - RNA, 19 nt, Artificial Sequence
  Description of Artificial Sequence: Synthetic oligonucleotide
uagcauucccggcuacaag

SEQ ID NO: 13670 - RNA, 19 nt, Artificial Sequence
  Description of Artificial Sequence: Synthetic oligonucleotide
ucagcauucccggcuacaa

SEQ ID NO: 13671 - RNA, 19 nt, Artificial Sequence
  Description of Artificial Sequence: Synthetic oligonucleotide
ugcagcauucccggcuaca

SEQ ID NO: 13672 - RNA, 19 nt, Artificial Sequence
  Description of Artificial Sequence: Synthetic oligonucleotide
uagcagcauucccggcuac

SEQ ID NO: 13673 - RNA, 19 nt, Artificial Sequence
  Description of Artificial Sequence: Synthetic oligonucleotide
ucagcagcauucccggcua

SEQ ID NO: 13674 - RNA, 19 nt, Artificial Sequence
  Description of Artificial Sequence: Synthetic oligonucleotide
ugcagcagcauucccggcu

SEQ ID NO: 13675 - RNA, 19 nt, Artificial Sequence
  Description of Artificial Sequence: Synthetic oligonucleotide
uagcagcagcauucccggc

SEQ ID NO: 13676 - RNA, 19 nt, Artificial Sequence
  Description of Artificial Sequence: Synthetic oligonucleotide
ucagcagcagcauucccgg

SEQ ID NO: 13677 - RNA, 19 nt, Artificial Sequence
  Description of Artificial Sequence: Synthetic oligonucleotide
ugcagcagcagcauucccg

SEQ ID NO: 13678 - RNA, 19 nt, Artificial Sequence
  Description of Artificial Sequence: Synthetic oligonucleotide
uagcagcagcagcauuccc

SEQ ID NO: 13679 - RNA, 19 nt, Artificial Sequence
  Description of Artificial Sequence: Synthetic oligonucleotide
ucagcagcagcagcauucc

SEQ ID NO: 13680 - RNA, 19 nt, Artificial Sequence
  Description of Artificial Sequence: Synthetic oligonucleotide
ugcagcagcagcagcauuc

SEQ ID NO: 13681 - RNA, 19 nt, Artificial Sequence
  Description of Artificial Sequence: Synthetic oligonucleotide
uagcagcagcagcagcauu

SEQ ID NO: 13682 - RNA, 19 nt, Artificial Sequence
  Description of Artificial Sequence: Synthetic oligonucleotide
ucagcagcagcagcagcau

SEQ ID NO: 13683 - RNA, 19 nt, Artificial Sequence
  Description of Artificial Sequence: Synthetic oligonucleotide
ugcagcagcagcagcagca

SEQ ID NO: 13684 - RNA, 19 nt, Artificial Sequence
  Description of Artificial Sequence: Synthetic oligonucleotide
uagcagcagcagcagcagc

SEQ ID NO: 13685 - RNA, 19 nt, Artificial Sequence
  Description of Artificial Sequence: Synthetic oligonucleotide
ucagcagcagcagcagcag

SEQ ID NO: 13686 - RNA, 19 nt, Artificial Sequence
  Description of Artificial Sequence: Synthetic oligonucleotide
ugcagcagcagcagcagca

SEQ ID NO: 13687 - RNA, 19 nt, Artificial Sequence
  Description of Artificial Sequence: Synthetic oligonucleotide
uagcagcagcagcagcagc

SEQ ID NO: 13688 - RNA, 19 nt, Artificial Sequence
  Description of Artificial Sequence: Synthetic oligonucleotide
ucagcagcagcagcagcag

SEQ ID NO: 13689 - RNA, 19 nt, Artificial Sequence
  Description of Artificial Sequence: Synthetic oligonucleotide
ugcagcagcagcagcagca

SEQ ID NO: 13690 - RNA, 19 nt, Artificial Sequence
  Description of Artificial Sequence: Synthetic oligonucleotide
uagcagcagcagcagcagc

SEQ ID NO: 13691 - RNA, 19 nt, Artificial Sequence
  Description of Artificial Sequence: Synthetic oligonucleotide
ucagcagcagcagcagcag

SEQ ID NO: 13692 - RNA, 19 nt, Artificial Sequence
  Description of Artificial Sequence: Synthetic oligonucleotide
ugcagcagcagcagcagca

SEQ ID NO: 13693 - RNA, 19 nt, Artificial Sequence
  Description of Artificial Sequence: Synthetic oligonucleotide
uagcagcagcagcagcagc

SEQ ID NO: 13694 - RNA, 19 nt, Artificial Sequence
  Description of Artificial Sequence: Synthetic oligonucleotide
ucagcagcagcagcagcag

SEQ ID NO: 13695 - RNA, 19 nt, Artificial Sequence
  Description of Artificial Sequence: Synthetic oligonucleotide
ugcagcagcagcagcagca

SEQ ID NO: 13696 - RNA, 19 nt, Artificial Sequence
  Description of Artificial Sequence: Synthetic oligonucleotide
uagcagcagcagcagcagc

SEQ ID NO: 13697 - RNA, 19 nt, Artificial Sequence
  Description of Artificial Sequence: Synthetic oligonucleotide
ucagcagcagcagcagcag

SEQ ID NO: 13698 - RNA, 19 nt, Artificial Sequence
  Description of Artificial Sequence: Synthetic oligonucleotide
ugcagcagcagcagcagca

SEQ ID NO: 13699 - RNA, 19 nt, Artificial Sequence
  Description of Artificial Sequence: Synthetic oligonucleotide
uagcagcagcagcagcagc

SEQ ID NO: 13700 - RNA, 19 nt, Artificial Sequence
  Description of Artificial Sequence: Synthetic oligonucleotide
ucagcagcagcagcagcag

SEQ ID NO: 13701 - RNA, 19 nt, Artificial Sequence
  Description of Artificial Sequence: Synthetic oligonucleotide
ugcagcagcagcagcagca

SEQ ID NO: 13702 - RNA, 19 nt, Artificial Sequence
  Description of Artificial Sequence: Synthetic oligonucleotide
uagcagcagcagcagcagc

SEQ ID NO: 13703 - RNA, 19 nt, Artificial Sequence
  Description of Artificial Sequence: Synthetic oligonucleotide
ucagcagcagcagcagcag

SEQ ID NO: 13704 - RNA, 19 nt, Artificial Sequence
  Description of Artificial Sequence: Synthetic oligonucleotide
ugcagcagcagcagcagca

SEQ ID NO: 13705 - RNA, 19 nt, Artificial Sequence
  Description of Artificial Sequence: Synthetic oligonucleotide
uagcagcagcagcagcagc

SEQ ID NO: 13706 - RNA, 19 nt, Artificial Sequence
  Description of Artificial Sequence: Synthetic oligonucleotide
ucagcagcagcagcagcag

SEQ ID NO: 13707 - RNA, 19 nt, Artificial Sequence
  Description of Artificial Sequence: Synthetic oligonucleotide
ugcagcagcagcagcagca

SEQ ID NO: 13708 - RNA, 19 nt, Artificial Sequence
  Description of Artificial Sequence: Synthetic oligonucleotide
uagcagcagcagcagcagc

SEQ ID NO: 13709 - RNA, 19 nt, Artificial Sequence
  Description of Artificial Sequence: Synthetic oligonucleotide
ucagcagcagcagcagcag

SEQ ID NO: 13710 - RNA, 19 nt, Artificial Sequence
  Description of Artificial Sequence: Synthetic oligonucleotide
ugcagcagcagcagcagca

SEQ ID NO: 13711 - RNA, 19 nt, Artificial Sequence
  Description of Artificial Sequence: Synthetic oligonucleotide
uagcagcagcagcagcagc

SEQ ID NO: 13712 - RNA, 19 nt, Artificial Sequence
  Description of Artificial Sequence: Synthetic oligonucleotide
ucagcagcagcagcagcag

SEQ ID NO: 13713 - RNA, 19 nt, Artificial Sequence
  Description of Artificial Sequence: Synthetic oligonucleotide
ugcagcagcagcagcagca

SEQ ID NO: 13714 - RNA, 19 nt, Artificial Sequence
  Description of Artificial Sequence: Synthetic oligonucleotide
uagcagcagcagcagcagc

SEQ ID NO: 13715 - RNA, 19 nt, Artificial Sequence
  Description of Artificial Sequence: Synthetic oligonucleotide
ucagcagcagcagcagcag

SEQ ID NO: 13716 - RNA, 19 nt, Artificial Sequence
  Description of Artificial Sequence: Synthetic oligonucleotide
ugcagcagcagcagcagca

SEQ ID NO: 13717 - RNA, 19 nt, Artificial Sequence
  Description of Artificial Sequence: Synthetic oligonucleotide
uagcagcagcagcagcagc

SEQ ID NO: 13718 - RNA, 19 nt, Artificial Sequence
  Description of Artificial Sequence: Synthetic oligonucleotide
ucagcagcagcagcagcag

SEQ ID NO: 13719 - RNA, 19 nt, Artificial Sequence
  Description of Artificial Sequence: Synthetic oligonucleotide
ugcagcagcagcagcagca

SEQ ID NO: 13720 - RNA, 19 nt, Artificial Sequence
  Description of Artificial Sequence: Synthetic oligonucleotide
uagcagcagcagcagcagc

SEQ ID NO: 13721 - RNA, 19 nt, Artificial Sequence
  Description of Artificial Sequence: Synthetic oligonucleotide
ucagcagcagcagcagcag

SEQ ID NO: 13722 - RNA, 19 nt, Artificial Sequence
  Description of Artificial Sequence: Synthetic oligonucleotide
ugcagcagcagcagcagca

SEQ ID NO: 13723 - RNA, 19 nt, Artificial Sequence
  Description of Artificial Sequence: Synthetic oligonucleotide
uagcagcagcagcagcagc

SEQ ID NO: 13724 - RNA, 19 nt, Artificial Sequence
  Description of Artificial Sequence: Synthetic oligonucleotide
ucagcagcagcagcagcag

SEQ ID NO: 13725 - RNA, 19 nt, Artificial Sequence
  Description of Artificial Sequence: Synthetic oligonucleotide
ugcagcagcagcagcagca

SEQ ID NO: 13726 - RNA, 19 nt, Artificial Sequence
  Description of Artificial Sequence: Synthetic oligonucleotide
uagcagcagcagcagcagc

SEQ ID NO: 13727 - RNA, 19 nt, Artificial Sequence
  Description of Artificial Sequence: Synthetic oligonucleotide
ucagcagcagcagcagcag

SEQ ID NO: 13728 - RNA, 19 nt, Artificial Sequence
  Description of Artificial Sequence: Synthetic oligonucleotide
uccagcagcagcagcagca

SEQ ID NO: 13729 - RNA, 19 nt, Artificial Sequence
  Description of Artificial Sequence: Synthetic oligonucleotide
ucccagcagcagcagcagc

SEQ ID NO: 13730 - RNA, 19 nt, Artificial Sequence
  Description of Artificial Sequence: Synthetic oligonucleotide
uccccagcagcagcagcag

SEQ ID NO: 13731 - RNA, 19 nt, Artificial Sequence
  Description of Artificial Sequence: Synthetic oligonucleotide
ucccccagcagcagcagca

SEQ ID NO: 13732 - RNA, 19 nt, Artificial Sequence
  Description of Artificial Sequence: Synthetic oligonucleotide
uccccccagcagcagcagc

SEQ ID NO: 13733 - RNA, 19 nt, Artificial Sequence
  Description of Artificial Sequence: Synthetic oligonucleotide
uuccccccagcagcagcag

SEQ ID NO: 13734 - RNA, 19 nt, Artificial Sequence
  Description of Artificial Sequence: Synthetic oligonucleotide
uauccccccagcagcagca

SEQ ID NO: 13735 - RNA, 19 nt, Artificial Sequence
  Description of Artificial Sequence: Synthetic oligonucleotide
ugauccccccagcagcagc

SEQ ID NO: 13736 - RNA, 19 nt, Artificial Sequence
  Description of Artificial Sequence: Synthetic oligonucleotide
uugauccccccagcagcag

SEQ ID NO: 13737 - RNA, 19 nt, Artificial Sequence
  Description of Artificial Sequence: Synthetic oligonucleotide
ugugauccccccagcagca

SEQ ID NO: 13738 - RNA, 19 nt, Artificial Sequence
  Description of Artificial Sequence: Synthetic oligonucleotide
uugugauccccccagcagc

SEQ ID NO: 13739 - RNA, 19 nt, Artificial Sequence
  Description of Artificial Sequence: Synthetic oligonucleotide
ucugugauccccccagcag

SEQ ID NO: 13740 - RNA, 19 nt, Artificial Sequence
  Description of Artificial Sequence: Synthetic oligonucleotide
uucugugauccccccagca

SEQ ID NO: 13741 - RNA, 19 nt, Artificial Sequence
  Description of Artificial Sequence: Synthetic oligonucleotide
ugucugugauccccccagc

SEQ ID NO: 13742 - RNA, 19 nt, Artificial Sequence
  Description of Artificial Sequence: Synthetic oligonucleotide
uggucugugauccccccag

SEQ ID NO: 13743 - RNA, 19 nt, Artificial Sequence
  Description of Artificial Sequence: Synthetic oligonucleotide
uuggucugugaucccccca

SEQ ID NO: 13744 - RNA, 19 nt, Artificial Sequence
  Description of Artificial Sequence: Synthetic oligonucleotide
uauggucugugaucccccc

SEQ ID NO: 13745 - RNA, 19 nt, Artificial Sequence
  Description of Artificial Sequence: Synthetic oligonucleotide
uaauggucugugauccccc

SEQ ID NO: 13746 - RNA, 19 nt, Artificial Sequence
  Description of Artificial Sequence: Synthetic oligonucleotide
uaaauggucugugaucccc

SEQ ID NO: 13747 - RNA, 19 nt, Artificial Sequence
  Description of Artificial Sequence: Synthetic oligonucleotide
ugaaauggucugugauccc

SEQ ID NO: 13748 - RNA, 19 nt, Artificial Sequence
  Description of Artificial Sequence: Synthetic oligonucleotide
uagaaauggucugugaucc

SEQ ID NO: 13749 - RNA, 19 nt, Artificial Sequence
  Description of Artificial Sequence: Synthetic oligonucleotide
uaagaaauggucugugauc

SEQ ID NO: 13750 - RNA, 19 nt, Artificial Sequence
  Description of Artificial Sequence: Synthetic oligonucleotide
uaaagaaauggucugugau

SEQ ID NO: 13751 - RNA, 19 nt, Artificial Sequence
  Description of Artificial Sequence: Synthetic oligonucleotide
ugaaagaaauggucuguga

SEQ ID NO: 13752 - RNA, 19 nt, Artificial Sequence
  Description of Artificial Sequence: Synthetic oligonucleotide
uagaaagaaauggucugug

SEQ ID NO: 13753 - RNA, 19 nt, Artificial Sequence
  Description of Artificial Sequence: Synthetic oligonucleotide
uaagaaagaaauggucugu

SEQ ID NO: 13754 - RNA, 19 nt, Artificial Sequence
  Description of Artificial Sequence: Synthetic oligonucleotide
uaaagaaagaaauggucug

SEQ ID NO: 13755 - RNA, 19 nt, Artificial Sequence
  Description of Artificial Sequence: Synthetic oligonucleotide
ugaaagaaagaaauggucu

SEQ ID NO: 13756 - RNA, 19 nt, Artificial Sequence
  Description of Artificial Sequence: Synthetic oligonucleotide
ucgaaagaaagaaaugguc

SEQ ID NO: 13757 - RNA, 19 nt, Artificial Sequence
  Description of Artificial Sequence: Synthetic oligonucleotide
uccgaaagaaagaaauggu

SEQ ID NO: 13758 - RNA, 19 nt, Artificial Sequence
  Description of Artificial Sequence: Synthetic oligonucleotide
ugccgaaagaaagaaaugg

SEQ ID NO: 13759 - RNA, 19 nt, Artificial Sequence
  Description of Artificial Sequence: Synthetic oligonucleotide
uggccgaaagaaagaaaug

SEQ ID NO: 13760 - RNA, 19 nt, Artificial Sequence
  Description of Artificial Sequence: Synthetic oligonucleotide
uuggccgaaagaaagaaau

SEQ ID NO: 13761 - RNA, 19 nt, Artificial Sequence
  Description of Artificial Sequence: Synthetic oligonucleotide
ucuggccgaaagaaagaaa

SEQ ID NO: 13762 - RNA, 19 nt, Artificial Sequence
  Description of Artificial Sequence: Synthetic oligonucleotide
uccuggccgaaagaaagaa

SEQ ID NO: 13763 - RNA, 19 nt, Artificial Sequence
  Description of Artificial Sequence: Synthetic oligonucleotide
ugccuggccgaaagaaaga

SEQ ID NO: 13764 - RNA, 19 nt, Artificial Sequence
  Description of Artificial Sequence: Synthetic oligonucleotide
uagccuggccgaaagaaag

SEQ ID NO: 13765 - RNA, 19 nt, Artificial Sequence
  Description of Artificial Sequence: Synthetic oligonucleotide
ucagccuggccgaaagaaa

SEQ ID NO: 13766 - RNA, 19 nt, Artificial Sequence
  Description of Artificial Sequence: Synthetic oligonucleotide
uucagccuggccgaaagaa

SEQ ID NO: 13767 - RNA, 19 nt, Artificial Sequence
  Description of Artificial Sequence: Synthetic oligonucleotide
ucucagccuggccgaaaga

SEQ ID NO: 13768 - RNA, 19 nt, Artificial Sequence
  Description of Artificial Sequence: Synthetic oligonucleotide
uccucagccuggccgaaag

SEQ ID NO: 13769 - RNA, 19 nt, Artificial Sequence
  Description of Artificial Sequence: Synthetic oligonucleotide
ugccucagccuggccgaaa

SEQ ID NO: 13770 - RNA, 19 nt, Artificial Sequence
  Description of Artificial Sequence: Synthetic oligonucleotide
uggccucagccuggccgaa

SEQ ID NO: 13771 - RNA, 19 nt, Artificial Sequence
  Description of Artificial Sequence: Synthetic oligonucleotide
ugggccucagccuggccga

SEQ ID NO: 13772 - RNA, 19 nt, Artificial Sequence
  Description of Artificial Sequence: Synthetic oligonucleotide
uagggccucagccuggccg

SEQ ID NO: 13773 - RNA, 19 nt, Artificial Sequence
  Description of Artificial Sequence: Synthetic oligonucleotide
ucagggccucagccuggcc

SEQ ID NO: 13774 - RNA, 19 nt, Artificial Sequence
  Description of Artificial Sequence: Synthetic oligonucleotide
uucagggccucagccuggc

SEQ ID NO: 13775 - RNA, 19 nt, Artificial Sequence
  Description of Artificial Sequence: Synthetic oligonucleotide
ugucagggccucagccugg

SEQ ID NO: 13776 - RNA, 19 nt, Artificial Sequence
  Description of Artificial Sequence: Synthetic oligonucleotide
ucgucagggccucagccug

SEQ ID NO: 13777 - RNA, 19 nt, Artificial Sequence
  Description of Artificial Sequence: Synthetic oligonucleotide
uacgucagggccucagccu

SEQ ID NO: 13778 - RNA, 19 nt, Artificial Sequence
  Description of Artificial Sequence: Synthetic oligonucleotide
ucacgucagggccucagcc

SEQ ID NO: 13779 - RNA, 19 nt, Artificial Sequence
  Description of Artificial Sequence: Synthetic oligonucleotide
uccacgucagggccucagc

SEQ ID NO: 13780 - RNA, 19 nt, Artificial Sequence
  Description of Artificial Sequence: Synthetic oligonucleotide
uuccacgucagggccucag

SEQ ID NO: 13781 - RNA, 19 nt, Artificial Sequence
  Description of Artificial Sequence: Synthetic oligonucleotide
uauccacgucagggccuca

SEQ ID NO: 13782 - RNA, 19 nt, Artificial Sequence
  Description of Artificial Sequence: Synthetic oligonucleotide
ucauccacgucagggccuc

SEQ ID NO: 13783 - RNA, 19 nt, Artificial Sequence
  Description of Artificial Sequence: Synthetic oligonucleotide
uccauccacgucagggccu

SEQ ID NO: 13784 - RNA, 19 nt, Artificial Sequence
  Description of Artificial Sequence: Synthetic oligonucleotide
ucccauccacgucagggcc

SEQ ID NO: 13785 - RNA, 19 nt, Artificial Sequence
  Description of Artificial Sequence: Synthetic oligonucleotide
ugcccauccacgucagggc

SEQ ID NO: 13786 - RNA, 19 nt, Artificial Sequence
  Description of Artificial Sequence: Synthetic oligonucleotide
uugcccauccacgucaggg

SEQ ID NO: 13787 - RNA, 19 nt, Artificial Sequence
  Description of Artificial Sequence: Synthetic oligonucleotide
uuugcccauccacgucagg

SEQ ID NO: 13788 - RNA, 19 nt, Artificial Sequence
  Description of Artificial Sequence: Synthetic oligonucleotide
uuuugcccauccacgucag

SEQ ID NO: 13789 - RNA, 19 nt, Artificial Sequence
  Description of Artificial Sequence: Synthetic oligonucleotide
uguuugcccauccacguca

SEQ ID NO: 13790 - RNA, 19 nt, Artificial Sequence
  Description of Artificial Sequence: Synthetic oligonucleotide
uaguuugcccauccacguc

SEQ ID NO: 13791 - RNA, 19 nt, Artificial Sequence
  Description of Artificial Sequence: Synthetic oligonucleotide
ucaguuugcccauccacgu

SEQ ID NO: 13792 - RNA, 19 nt, Artificial Sequence
  Description of Artificial Sequence: Synthetic oligonucleotide
ugcaguuugcccauccacg

SEQ ID NO: 13793 - RNA, 19 nt, Artificial Sequence
  Description of Artificial Sequence: Synthetic oligonucleotide
uugcaguuugcccauccac

SEQ ID NO: 13794 - RNA, 19 nt, Artificial Sequence
  Description of Artificial Sequence: Synthetic oligonucleotide
ucugcaguuugcccaucca

SEQ ID NO: 13795 - RNA, 19 nt, Artificial Sequence
  Description of Artificial Sequence: Synthetic oligonucleotide
uccugcaguuugcccaucc

SEQ ID NO: 13796 - RNA, 19 nt, Artificial Sequence
  Description of Artificial Sequence: Synthetic oligonucleotide
ugccugcaguuugcccauc

SEQ ID NO: 13797 - RNA, 19 nt, Artificial Sequence
  Description of Artificial Sequence: Synthetic oligonucleotide
uggccugcaguuugcccau

SEQ ID NO: 13798 - RNA, 19 nt, Artificial Sequence
  Description of Artificial Sequence: Synthetic oligonucleotide
uaggccugcaguuugccca

SEQ ID NO: 13799 - RNA, 19 nt, Artificial Sequence
  Description of Artificial Sequence: Synthetic oligonucleotide
ucaggccugcaguuugccc

SEQ ID NO: 13800 - RNA, 19 nt, Artificial Sequence
  Description of Artificial Sequence: Synthetic oligonucleotide
uccaggccugcaguuugcc

SEQ ID NO: 13801 - RNA, 19 nt, Artificial Sequence
  Description of Artificial Sequence: Synthetic oligonucleotide
ucccaggccugcaguuugc

SEQ ID NO: 13802 - RNA, 19 nt, Artificial Sequence
  Description of Artificial Sequence: Synthetic oligonucleotide
uucccaggccugcaguuug

SEQ ID NO: 13803 - RNA, 19 nt, Artificial Sequence
  Description of Artificial Sequence: Synthetic oligonucleotide
uuucccaggccugcaguuu

SEQ ID NO: 13804 - RNA, 19 nt, Artificial Sequence
  Description of Artificial Sequence: Synthetic oligonucleotide
ucuucccaggccugcaguu

SEQ ID NO: 13805 - RNA, 19 nt, Artificial Sequence
  Description of Artificial Sequence: Synthetic oligonucleotide
uccuucccaggccugcagu

SEQ ID NO: 13806 - RNA, 19 nt, Artificial Sequence
  Description of Artificial Sequence: Synthetic oligonucleotide
ugccuucccaggccugcag

SEQ ID NO: 13807 - RNA, 19 nt, Artificial Sequence
  Description of Artificial Sequence: Synthetic oligonucleotide
uugccuucccaggccugca

SEQ ID NO: 13808 - RNA, 19 nt, Artificial Sequence
  Description of Artificial Sequence: Synthetic oligonucleotide
ucugccuucccaggccugc

SEQ ID NO: 13809 - RNA, 19 nt, Artificial Sequence
  Description of Artificial Sequence: Synthetic oligonucleotide
ugcugccuucccaggccug

SEQ ID NO: 13810 - RNA, 19 nt, Artificial Sequence
  Description of Artificial Sequence: Synthetic oligonucleotide
uugcugccuucccaggccu

SEQ ID NO: 13811 - RNA, 19 nt, Artificial Sequence
  Description of Artificial Sequence: Synthetic oligonucleotide
uuugcugccuucccaggcc

SEQ ID NO: 13812 - RNA, 19 nt, Artificial Sequence
  Description of Artificial Sequence: Synthetic oligonucleotide
ucuugcugccuucccaggc

SEQ ID NO: 13813 - RNA, 19 nt, Artificial Sequence
  Description of Artificial Sequence: Synthetic oligonucleotide
ugcuugcugccuucccagg

SEQ ID NO: 13814 - RNA, 19 nt, Artificial Sequence
  Description of Artificial Sequence: Synthetic oligonucleotide
uggcuugcugccuucccag

SEQ ID NO: 13815 - RNA, 19 nt, Artificial Sequence
  Description of Artificial Sequence: Synthetic oligonucleotide
ucggcuugcugccuuccca

SEQ ID NO: 13816 - RNA, 19 nt, Artificial Sequence
  Description of Artificial Sequence: Synthetic oligonucleotide
uccggcuugcugccuuccc

SEQ ID NO: 13817 - RNA, 19 nt, Artificial Sequence
  Description of Artificial Sequence: Synthetic oligonucleotide
ucccggcuugcugccuucc

SEQ ID NO: 13818 - RNA, 19 nt, Artificial Sequence
  Description of Artificial Sequence: Synthetic oligonucleotide
ugcccggcuugcugccuuc

SEQ ID NO: 13819 - RNA, 19 nt, Artificial Sequence
  Description of Artificial Sequence: Synthetic oligonucleotide
uggcccggcuugcugccuu

SEQ ID NO: 13820 - RNA, 19 nt, Artificial Sequence
  Description of Artificial Sequence: Synthetic oligonucleotide
ucggcccggcuugcugccu

SEQ ID NO: 13821 - RNA, 19 nt, Artificial Sequence
  Description of Artificial Sequence: Synthetic oligonucleotide
uacggcccggcuugcugcc

SEQ ID NO: 13822 - RNA, 19 nt, Artificial Sequence
  Description of Artificial Sequence: Synthetic oligonucleotide
ugacggcccggcuugcugc

SEQ ID NO: 13823 - RNA, 19 nt, Artificial Sequence
  Description of Artificial Sequence: Synthetic oligonucleotide
uggacggcccggcuugcug

SEQ ID NO: 13824 - RNA, 19 nt, Artificial Sequence
  Description of Artificial Sequence: Synthetic oligonucleotide
ucggacggcccggcuugcu

SEQ ID NO: 13825 - RNA, 19 nt, Artificial Sequence
  Description of Artificial Sequence: Synthetic oligonucleotide
uacggacggcccggcuugc

SEQ ID NO: 13826 - RNA, 19 nt, Artificial Sequence
  Description of Artificial Sequence: Synthetic oligonucleotide
ucacggacggcccggcuug

SEQ ID NO: 13827 - RNA, 19 nt, Artificial Sequence
  Description of Artificial Sequence: Synthetic oligonucleotide
uacacggacggcccggcuu

SEQ ID NO: 13828 - RNA, 19 nt, Artificial Sequence
  Description of Artificial Sequence: Synthetic oligonucleotide
uaacacggacggcccggcu

SEQ ID NO: 13829 - RNA, 19 nt, Artificial Sequence
  Description of Artificial Sequence: Synthetic oligonucleotide
ugaacacggacggcccggc

SEQ ID NO: 13830 - RNA, 19 nt, Artificial Sequence
  Description of Artificial Sequence: Synthetic oligonucleotide
uggaacacggacggcccgg

SEQ ID NO: 13831 - RNA, 19 nt, Artificial Sequence
  Description of Artificial Sequence: Synthetic oligonucleotide
uuggaacacggacggcccg

SEQ ID NO: 13832 - RNA, 19 nt, Artificial Sequence
  Description of Artificial Sequence: Synthetic oligonucleotide
uauggaacacggacggccc

SEQ ID NO: 13833 - RNA, 19 nt, Artificial Sequence
  Description of Artificial Sequence: Synthetic oligonucleotide
ugauggaacacggacggcc

SEQ ID NO: 13834 - RNA, 19 nt, Artificial Sequence
  Description of Artificial Sequence: Synthetic oligonucleotide
uggauggaacacggacggc

SEQ ID NO: 13835 - RNA, 19 nt, Artificial Sequence
  Description of Artificial Sequence: Synthetic oligonucleotide
uaggauggaacacggacgg

SEQ ID NO: 13836 - RNA, 19 nt, Artificial Sequence
  Description of Artificial Sequence: Synthetic oligonucleotide
ugaggauggaacacggacg

SEQ ID NO: 13837 - RNA, 19 nt, Artificial Sequence
  Description of Artificial Sequence: Synthetic oligonucleotide
uggaggauggaacacggac

SEQ ID NO: 13838 - RNA, 19 nt, Artificial Sequence
  Description of Artificial Sequence: Synthetic oligonucleotide
uuggaggauggaacacgga

SEQ ID NO: 13839 - RNA, 19 nt, Artificial Sequence
  Description of Artificial Sequence: Synthetic oligonucleotide
uguggaggauggaacacgg

SEQ ID NO: 13840 - RNA, 19 nt, Artificial Sequence
  Description of Artificial Sequence: Synthetic oligonucleotide
ucguggaggauggaacacg

SEQ ID NO: 13841 - RNA, 19 nt, Artificial Sequence
  Description of Artificial Sequence: Synthetic oligonucleotide
ugcguggaggauggaacac

SEQ ID NO: 13842 - RNA, 19 nt, Artificial Sequence
  Description of Artificial Sequence: Synthetic oligonucleotide
uugcguggaggauggaaca

SEQ ID NO: 13843 - RNA, 19 nt, Artificial Sequence
  Description of Artificial Sequence: Synthetic oligonucleotide
ugugcguggaggauggaac

SEQ ID NO: 13844 - RNA, 19 nt, Artificial Sequence
  Description of Artificial Sequence: Synthetic oligonucleotide
uggugcguggaggauggaa

SEQ ID NO: 13845 - RNA, 19 nt, Artificial Sequence
  Description of Artificial Sequence: Synthetic oligonucleotide
ugggugcguggaggaugga

SEQ ID NO: 13846 - RNA, 19 nt, Artificial Sequence
  Description of Artificial Sequence: Synthetic oligonucleotide
uggggugcguggaggaugg

SEQ ID NO: 13847 - RNA, 19 nt, Artificial Sequence
  Description of Artificial Sequence: Synthetic oligonucleotide
ugggggugcguggaggaug

SEQ ID NO: 13848 - RNA, 19 nt, Artificial Sequence
  Description of Artificial Sequence: Synthetic oligonucleotide
uugggggugcguggaggau

SEQ ID NO: 13849 - RNA, 19 nt, Artificial Sequence
  Description of Artificial Sequence: Synthetic oligonucleotide
ugugggggugcguggagga

SEQ ID NO: 13850 - RNA, 19 nt, Artificial Sequence
  Description of Artificial Sequence: Synthetic oligonucleotide
uggugggggugcguggagg

SEQ ID NO: 13851 - RNA, 19 nt, Artificial Sequence
  Description of Artificial Sequence: Synthetic oligonucleotide
uaggugggggugcguggag

SEQ ID NO: 13852 - RNA, 19 nt, Artificial Sequence
  Description of Artificial Sequence: Synthetic oligonucleotide
uuaggugggggugcgugga

SEQ ID NO: 13853 - RNA, 19 nt, Artificial Sequence
  Description of Artificial Sequence: Synthetic oligonucleotide
uauaggugggggugcgugg

SEQ ID NO: 13854 - RNA, 19 nt, Artificial Sequence
  Description of Artificial Sequence: Synthetic oligonucleotide
ugauaggugggggugcgug

SEQ ID NO: 13855 - RNA, 19 nt, Artificial Sequence
  Description of Artificial Sequence: Synthetic oligonucleotide
ucgauaggugggggugcgu

SEQ ID NO: 13856 - RNA, 19 nt, Artificial Sequence
  Description of Artificial Sequence: Synthetic oligonucleotide
uacgauaggugggggugcg

SEQ ID NO: 13857 - RNA, 19 nt, Artificial Sequence
  Description of Artificial Sequence: Synthetic oligonucleotide
uaacgauaggugggggugc

SEQ ID NO: 13858 - RNA, 19 nt, Artificial Sequence
  Description of Artificial Sequence: Synthetic oligonucleotide
ucaacgauaggugggggug

SEQ ID NO: 13859 - RNA, 19 nt, Artificial Sequence
  Description of Artificial Sequence: Synthetic oligonucleotide
uccaacgauaggugggggu

SEQ ID NO: 13860 - RNA, 19 nt, Artificial Sequence
  Description of Artificial Sequence: Synthetic oligonucleotide
uaccaacgauagguggggg

SEQ ID NO: 13861 - RNA, 19 nt, Artificial Sequence
  Description of Artificial Sequence: Synthetic oligonucleotide
uaaccaacgauaggugggg

SEQ ID NO: 13862 - RNA, 19 nt, Artificial Sequence
  Description of Artificial Sequence: Synthetic oligonucleotide
ugaaccaacgauagguggg

SEQ ID NO: 13863 - RNA, 19 nt, Artificial Sequence
  Description of Artificial Sequence: Synthetic oligonucleotide
ucgaaccaacgauaggugg

SEQ ID NO: 13864 - RNA, 19 nt, Artificial Sequence
  Description of Artificial Sequence: Synthetic oligonucleotide
ugcgaaccaacgauaggug

SEQ ID NO: 13865 - RNA, 19 nt, Artificial Sequence
  Description of Artificial Sequence: Synthetic oligonucleotide
uugcgaaccaacgauaggu

SEQ ID NO: 13866 - RNA, 19 nt, Artificial Sequence
  Description of Artificial Sequence: Synthetic oligonucleotide
uuugcgaaccaacgauagg

SEQ ID NO: 13867 - RNA, 19 nt, Artificial Sequence
  Description of Artificial Sequence: Synthetic oligonucleotide
uuuugcgaaccaacgauag

SEQ ID NO: 13868 - RNA, 19 nt, Artificial Sequence
  Description of Artificial Sequence: Synthetic oligonucleotide
ucuuugcgaaccaacgaua

SEQ ID NO: 13869 - RNA, 19 nt, Artificial Sequence
  Description of Artificial Sequence: Synthetic oligonucleotide
uacuuugcgaaccaacgau

SEQ ID NO: 13870 - RNA, 19 nt, Artificial Sequence
  Description of Artificial Sequence: Synthetic oligonucleotide
ucacuuugcgaaccaacga

SEQ ID NO: 13871 - RNA, 19 nt, Artificial Sequence
  Description of Artificial Sequence: Synthetic oligonucleotide
ugcacuuugcgaaccaacg

SEQ ID NO: 13872 - RNA, 19 nt, Artificial Sequence
  Description of Artificial Sequence: Synthetic oligonucleotide
uugcacuuugcgaaccaac

SEQ ID NO: 13873 - RNA, 19 nt, Artificial Sequence
  Description of Artificial Sequence: Synthetic oligonucleotide
uuugcacuuugcgaaccaa

SEQ ID NO: 13874 - RNA, 19 nt, Artificial Sequence
  Description of Artificial Sequence: Synthetic oligonucleotide
uuuugcacuuugcgaacca

SEQ ID NO: 13875 - RNA, 19 nt, Artificial Sequence
  Description of Artificial Sequence: Synthetic oligonucleotide
ucuuugcacuuugcgaacc

SEQ ID NO: 13876 - RNA, 19 nt, Artificial Sequence
  Description of Artificial Sequence: Synthetic oligonucleotide
ugcuuugcacuuugcgaac

SEQ ID NO: 13877 - RNA, 19 nt, Artificial Sequence
  Description of Artificial Sequence: Synthetic oligonucleotide
uagcuuugcacuuugcgaa

SEQ ID NO: 13878 - RNA, 19 nt, Artificial Sequence
  Description of Artificial Sequence: Synthetic oligonucleotide
uaagcuuugcacuuugcga

SEQ ID NO: 13879 - RNA, 19 nt, Artificial Sequence
  Description of Artificial Sequence: Synthetic oligonucleotide
uaaagcuuugcacuuugcg

SEQ ID NO: 13880 - RNA, 19 nt, Artificial Sequence
  Description of Artificial Sequence: Synthetic oligonucleotide
ugaaagcuuugcacuuugc

SEQ ID NO: 13881 - RNA, 19 nt, Artificial Sequence
  Description of Artificial Sequence: Synthetic oligonucleotide
uagaaagcuuugcacuuug

SEQ ID NO: 13882 - RNA, 19 nt, Artificial Sequence
  Description of Artificial Sequence: Synthetic oligonucleotide
uaagaaagcuuugcacuuu

SEQ ID NO: 13883 - RNA, 19 nt, Artificial Sequence
  Description of Artificial Sequence: Synthetic oligonucleotide
ucaagaaagcuuugcacuu

SEQ ID NO: 13884 - RNA, 19 nt, Artificial Sequence
  Description of Artificial Sequence: Synthetic oligonucleotide
uacaagaaagcuuugcacu

SEQ ID NO: 13885 - RNA, 19 nt, Artificial Sequence
  Description of Artificial Sequence: Synthetic oligonucleotide
ucacaagaaagcuuugcac

SEQ ID NO: 13886 - RNA, 19 nt, Artificial Sequence
  Description of Artificial Sequence: Synthetic oligonucleotide
ugcacaagaaagcuuugca

SEQ ID NO: 13887 - RNA, 19 nt, Artificial Sequence
  Description of Artificial Sequence: Synthetic oligonucleotide
uugcacaagaaagcuuugc

SEQ ID NO: 13888 - RNA, 19 nt, Artificial Sequence
  Description of Artificial Sequence: Synthetic oligonucleotide
uaugcacaagaaagcuuug

SEQ ID NO: 13889 - RNA, 19 nt, Artificial Sequence
  Description of Artificial Sequence: Synthetic oligonucleotide
ucaugcacaagaaagcuuu

SEQ ID NO: 13890 - RNA, 19 nt, Artificial Sequence
  Description of Artificial Sequence: Synthetic oligonucleotide
uucaugcacaagaaagcuu

SEQ ID NO: 13891 - RNA, 19 nt, Artificial Sequence
  Description of Artificial Sequence: Synthetic oligonucleotide
ugucaugcacaagaaagcu

SEQ ID NO: 13892 - RNA, 19 nt, Artificial Sequence
  Description of Artificial Sequence: Synthetic oligonucleotide
ucgucaugcacaagaaagc

SEQ ID NO: 13893 - RNA, 19 nt, Artificial Sequence
  Description of Artificial Sequence: Synthetic oligonucleotide
ugcgucaugcacaagaaag

SEQ ID NO: 13894 - RNA, 19 nt, Artificial Sequence
  Description of Artificial Sequence: Synthetic oligonucleotide
uggcgucaugcacaagaaa

SEQ ID NO: 13895 - RNA, 19 nt, Artificial Sequence
  Description of Artificial Sequence: Synthetic oligonucleotide
ugggcgucaugcacaagaa

SEQ ID NO: 13896 - RNA, 19 nt, Artificial Sequence
  Description of Artificial Sequence: Synthetic oligonucleotide
uagggcgucaugcacaaga

SEQ ID NO: 13897 - RNA, 19 nt, Artificial Sequence
  Description of Artificial Sequence: Synthetic oligonucleotide
ucagggcgucaugcacaag

SEQ ID NO: 13898 - RNA, 19 nt, Artificial Sequence
  Description of Artificial Sequence: Synthetic oligonucleotide
ugcagggcgucaugcacaa

SEQ ID NO: 13899 - RNA, 19 nt, Artificial Sequence
  Description of Artificial Sequence: Synthetic oligonucleotide
uagcagggcgucaugcaca

SEQ ID NO: 13900 - RNA, 19 nt, Artificial Sequence
  Description of Artificial Sequence: Synthetic oligonucleotide
ugagcagggcgucaugcac

SEQ ID NO: 13901 - RNA, 19 nt, Artificial Sequence
  Description of Artificial Sequence: Synthetic oligonucleotide
uagagcagggcgucaugca

SEQ ID NO: 13902 - RNA, 19 nt, Artificial Sequence
  Description of Artificial Sequence: Synthetic oligonucleotide
ucagagcagggcgucaugc

SEQ ID NO: 13903 - RNA, 19 nt, Artificial Sequence
  Description of Artificial Sequence: Synthetic oligonucleotide
uccagagcagggcgucaug

SEQ ID NO: 13904 - RNA, 19 nt, Artificial Sequence
  Description of Artificial Sequence: Synthetic oligonucleotide
ucccagagcagggcgucau

SEQ ID NO: 13905 - RNA, 19 nt, Artificial Sequence
  Description of Artificial Sequence: Synthetic oligonucleotide
uccccagagcagggcguca

SEQ ID NO: 13906 - RNA, 19 nt, Artificial Sequence
  Description of Artificial Sequence: Synthetic oligonucleotide
uuccccagagcagggcguc

SEQ ID NO: 13907 - RNA, 19 nt, Artificial Sequence
  Description of Artificial Sequence: Synthetic oligonucleotide
ucuccccagagcagggcgu

SEQ ID NO: 13908 - RNA, 19 nt, Artificial Sequence
  Description of Artificial Sequence: Synthetic oligonucleotide
ugcuccccagagcagggcg

SEQ ID NO: 13909 - RNA, 19 nt, Artificial Sequence
  Description of Artificial Sequence: Synthetic oligonucleotide
ucgcuccccagagcagggc

SEQ ID NO: 13910 - RNA, 19 nt, Artificial Sequence
  Description of Artificial Sequence: Synthetic oligonucleotide
uacgcuccccagagcaggg

SEQ ID NO: 13911 - RNA, 19 nt, Artificial Sequence
  Description of Artificial Sequence: Synthetic oligonucleotide
ugacgcuccccagagcagg

SEQ ID NO: 13912 - RNA, 19 nt, Artificial Sequence
  Description of Artificial Sequence: Synthetic oligonucleotide
uagacgcuccccagagcag

SEQ ID NO: 13913 - RNA, 19 nt, Artificial Sequence
  Description of Artificial Sequence: Synthetic oligonucleotide
ucagacgcuccccagagca

SEQ ID NO: 13914 - RNA, 19 nt, Artificial Sequence
  Description of Artificial Sequence: Synthetic oligonucleotide
uccagacgcuccccagagc

SEQ ID NO: 13915 - RNA, 19 nt, Artificial Sequence
  Description of Artificial Sequence: Synthetic oligonucleotide
ugccagacgcuccccagag

SEQ ID NO: 13916 - RNA, 19 nt, Artificial Sequence
  Description of Artificial Sequence: Synthetic oligonucleotide
ucgccagacgcuccccaga

SEQ ID NO: 13917 - RNA, 19 nt, Artificial Sequence
  Description of Artificial Sequence: Synthetic oligonucleotide
ugcgccagacgcuccccag

SEQ ID NO: 13918 - RNA, 19 nt, Artificial Sequence
  Description of Artificial Sequence: Synthetic oligonucleotide
ucgcgccagacgcucccca

SEQ ID NO: 13919 - RNA, 19 nt, Artificial Sequence
  Description of Artificial Sequence: Synthetic oligonucleotide
uucgcgccagacgcucccc

SEQ ID NO: 13920 - RNA, 19 nt, Artificial Sequence
  Description of Artificial Sequence: Synthetic oligonucleotide
uaucgcgccagacgcuccc

SEQ ID NO: 13921 - RNA, 19 nt, Artificial Sequence
  Description of Artificial Sequence: Synthetic oligonucleotide
ugaucgcgccagacgcucc

SEQ ID NO: 13922 - RNA, 19 nt, Artificial Sequence
  Description of Artificial Sequence: Synthetic oligonucleotide
uagaucgcgccagacgcuc

SEQ ID NO: 13923 - RNA, 19 nt, Artificial Sequence
  Description of Artificial Sequence: Synthetic oligonucleotide
ugagaucgcgccagacgcu

SEQ ID NO: 13924 - RNA, 19 nt, Artificial Sequence
  Description of Artificial Sequence: Synthetic oligonucleotide
uagagaucgcgccagacgc

SEQ ID NO: 13925 - RNA, 19 nt, Artificial Sequence
  Description of Artificial Sequence: Synthetic oligonucleotide
ucagagaucgcgccagacg

SEQ ID NO: 13926 - RNA, 19 nt, Artificial Sequence
  Description of Artificial Sequence: Synthetic oligonucleotide
ugcagagaucgcgccagac

SEQ ID NO: 13927 - RNA, 19 nt, Artificial Sequence
  Description of Artificial Sequence: Synthetic oligonucleotide
uggcagagaucgcgccaga

SEQ ID NO: 13928 - RNA, 19 nt, Artificial Sequence
  Description of Artificial Sequence: Synthetic oligonucleotide
uaggcagagaucgcgccag

SEQ ID NO: 13929 - RNA, 19 nt, Artificial Sequence
  Description of Artificial Sequence: Synthetic oligonucleotide
ucaggcagagaucgcgcca

SEQ ID NO: 13930 - RNA, 19 nt, Artificial Sequence
  Description of Artificial Sequence: Synthetic oligonucleotide
ugcaggcagagaucgcgcc

SEQ ID NO: 13931 - RNA, 19 nt, Artificial Sequence
  Description of Artificial Sequence: Synthetic oligonucleotide
uagcaggcagagaucgcgc

SEQ ID NO: 13932 - RNA, 19 nt, Artificial Sequence
  Description of Artificial Sequence: Synthetic oligonucleotide
uaagcaggcagagaucgcg

SEQ ID NO: 13933 - RNA, 19 nt, Artificial Sequence
  Description of Artificial Sequence: Synthetic oligonucleotide
uuaagcaggcagagaucgc

SEQ ID NO: 13934 - RNA, 19 nt, Artificial Sequence
  Description of Artificial Sequence: Synthetic oligonucleotide
uguaagcaggcagagaucg

SEQ ID NO: 13935 - RNA, 19 nt, Artificial Sequence
  Description of Artificial Sequence: Synthetic oligonucleotide
uaguaagcaggcagagauc

SEQ ID NO: 13936 - RNA, 19 nt, Artificial Sequence
  Description of Artificial Sequence: Synthetic oligonucleotide
ugaguaagcaggcagagau

SEQ ID NO: 13937 - RNA, 19 nt, Artificial Sequence
  Description of Artificial Sequence: Synthetic oligonucleotide
ucgaguaagcaggcagaga

SEQ ID NO: 13938 - RNA, 19 nt, Artificial Sequence
  Description of Artificial Sequence: Synthetic oligonucleotide
uccgaguaagcaggcagag

SEQ ID NO: 13939 - RNA, 19 nt, Artificial Sequence
  Description of Artificial Sequence: Synthetic oligonucleotide
ucccgaguaagcaggcaga

SEQ ID NO: 13940 - RNA, 19 nt, Artificial Sequence
  Description of Artificial Sequence: Synthetic oligonucleotide
uucccgaguaagcaggcag

SEQ ID NO: 13941 - RNA, 19 nt, Artificial Sequence
  Description of Artificial Sequence: Synthetic oligonucleotide
uuucccgaguaagcaggca

SEQ ID NO: 13942 - RNA, 19 nt, Artificial Sequence
  Description of Artificial Sequence: Synthetic oligonucleotide
uuuucccgaguaagcaggc

SEQ ID NO: 13943 - RNA, 19 nt, Artificial Sequence
  Description of Artificial Sequence: Synthetic oligonucleotide
uauuucccgaguaagcagg

SEQ ID NO: 13944 - RNA, 19 nt, Artificial Sequence
  Description of Artificial Sequence: Synthetic oligonucleotide
uaauuucccgaguaagcag

SEQ ID NO: 13945 - RNA, 19 nt, Artificial Sequence
  Description of Artificial Sequence: Synthetic oligonucleotide
uaaauuucccgaguaagca

SEQ ID NO: 13946 - RNA, 19 nt, Artificial Sequence
  Description of Artificial Sequence: Synthetic oligonucleotide
ucaaauuucccgaguaagc

SEQ ID NO: 13947 - RNA, 19 nt, Artificial Sequence
  Description of Artificial Sequence: Synthetic oligonucleotide
ugcaaauuucccgaguaag

SEQ ID NO: 13948 - RNA, 19 nt, Artificial Sequence
  Description of Artificial Sequence: Synthetic oligonucleotide
uagcaaauuucccgaguaa

SEQ ID NO: 13949 - RNA, 19 nt, Artificial Sequence
  Description of Artificial Sequence: Synthetic oligonucleotide
uaagcaaauuucccgagua

SEQ ID NO: 13950 - RNA, 19 nt, Artificial Sequence
  Description of Artificial Sequence: Synthetic oligonucleotide
uaaagcaaauuucccgagu

SEQ ID NO: 13951 - RNA, 19 nt, Artificial Sequence
  Description of Artificial Sequence: Synthetic oligonucleotide
uaaaagcaaauuucccgag

SEQ ID NO: 13952 - RNA, 19 nt, Artificial Sequence
  Description of Artificial Sequence: Synthetic oligonucleotide
ucaaaagcaaauuucccga

SEQ ID NO: 13953 - RNA, 19 nt, Artificial Sequence
  Description of Artificial Sequence: Synthetic oligonucleotide
ugcaaaagcaaauuucccg

SEQ ID NO: 13954 - RNA, 19 nt, Artificial Sequence
  Description of Artificial Sequence: Synthetic oligonucleotide
uggcaaaagcaaauuuccc

SEQ ID NO: 13955 - RNA, 19 nt, Artificial Sequence
  Description of Artificial Sequence: Synthetic oligonucleotide
uuggcaaaagcaaauuucc

SEQ ID NO: 13956 - RNA, 19 nt, Artificial Sequence
  Description of Artificial Sequence: Synthetic oligonucleotide
uuuggcaaaagcaaauuuc

SEQ ID NO: 13957 - RNA, 19 nt, Artificial Sequence
  Description of Artificial Sequence: Synthetic oligonucleotide
uuuuggcaaaagcaaauuu

SEQ ID NO: 13958 - RNA, 19 nt, Artificial Sequence
  Description of Artificial Sequence: Synthetic oligonucleotide
uguuuggcaaaagcaaauu

SEQ ID NO: 13959 - RNA, 19 nt, Artificial Sequence
  Description of Artificial Sequence: Synthetic oligonucleotide
ugguuuggcaaaagcaaau

SEQ ID NO: 13960 - RNA, 19 nt, Artificial Sequence
  Description of Artificial Sequence: Synthetic oligonucleotide
uggguuuggcaaaagcaaa

SEQ ID NO: 13961 - RNA, 19 nt, Artificial Sequence
  Description of Artificial Sequence: Synthetic oligonucleotide
ucggguuuggcaaaagcaa

SEQ ID NO: 13962 - RNA, 19 nt, Artificial Sequence
  Description of Artificial Sequence: Synthetic oligonucleotide
ugcggguuuggcaaaagca

SEQ ID NO: 13963 - RNA, 19 nt, Artificial Sequence
  Description of Artificial Sequence: Synthetic oligonucleotide
uagcggguuuggcaaaagc

SEQ ID NO: 13964 - RNA, 19 nt, Artificial Sequence
  Description of Artificial Sequence: Synthetic oligonucleotide
uaagcggguuuggcaaaag

SEQ ID NO: 13965 - RNA, 19 nt, Artificial Sequence
  Description of Artificial Sequence: Synthetic oligonucleotide
uaaagcggguuuggcaaaa

SEQ ID NO: 13966 - RNA, 19 nt, Artificial Sequence
  Description of Artificial Sequence: Synthetic oligonucleotide
uaaaagcggguuuggcaaa

SEQ ID NO: 13967 - RNA, 19 nt, Artificial Sequence
  Description of Artificial Sequence: Synthetic oligonucleotide
uaaaaagcggguuuggcaa

SEQ ID NO: 13968 - RNA, 19 nt, Artificial Sequence
  Description of Artificial Sequence: Synthetic oligonucleotide
ugaaaaagcggguuuggca

SEQ ID NO: 13969 - RNA, 19 nt, Artificial Sequence
  Description of Artificial Sequence: Synthetic oligonucleotide
ucgaaaaagcggguuuggc

SEQ ID NO: 13970 - RNA, 19 nt, Artificial Sequence
  Description of Artificial Sequence: Synthetic oligonucleotide
uccgaaaaagcggguuugg

SEQ ID NO: 13971 - RNA, 19 nt, Artificial Sequence
  Description of Artificial Sequence: Synthetic oligonucleotide
ucccgaaaaagcggguuug

SEQ ID NO: 13972 - RNA, 19 nt, Artificial Sequence
  Description of Artificial Sequence: Synthetic oligonucleotide
uccccgaaaaagcggguuu

SEQ ID NO: 13973 - RNA, 19 nt, Artificial Sequence
  Description of Artificial Sequence: Synthetic oligonucleotide
uuccccgaaaaagcggguu

SEQ ID NO: 13974 - RNA, 19 nt, Artificial Sequence
  Description of Artificial Sequence: Synthetic oligonucleotide
uauccccgaaaaagcgggu

SEQ ID NO: 13975 - RNA, 19 nt, Artificial Sequence
  Description of Artificial Sequence: Synthetic oligonucleotide
ugauccccgaaaaagcggg

SEQ ID NO: 13976 - RNA, 19 nt, Artificial Sequence
  Description of Artificial Sequence: Synthetic oligonucleotide
uggauccccgaaaaagcgg

SEQ ID NO: 13977 - RNA, 19 nt, Artificial Sequence
  Description of Artificial Sequence: Synthetic oligonucleotide
ugggauccccgaaaaagcg

SEQ ID NO: 13978 - RNA, 19 nt, Artificial Sequence
  Description of Artificial Sequence: Synthetic oligonucleotide
ucgggauccccgaaaaagc

SEQ ID NO: 13979 - RNA, 19 nt, Artificial Sequence
  Description of Artificial Sequence: Synthetic oligonucleotide
ugcgggauccccgaaaaag

SEQ ID NO: 13980 - RNA, 19 nt, Artificial Sequence
  Description of Artificial Sequence: Synthetic oligonucleotide
ucgcgggauccccgaaaaa

SEQ ID NO: 13981 - RNA, 19 nt, Artificial Sequence
  Description of Artificial Sequence: Synthetic oligonucleotide
ugcgcgggauccccgaaaa

SEQ ID NO: 13982 - RNA, 19 nt, Artificial Sequence
  Description of Artificial Sequence: Synthetic oligonucleotide
uggcgcgggauccccgaaa

SEQ ID NO: 13983 - RNA, 19 nt, Artificial Sequence
  Description of Artificial Sequence: Synthetic oligonucleotide
ugggcgcgggauccccgaa

SEQ ID NO: 13984 - RNA, 19 nt, Artificial Sequence
  Description of Artificial Sequence: Synthetic oligonucleotide
uggggcgcgggauccccga

SEQ ID NO: 13985 - RNA, 19 nt, Artificial Sequence
  Description of Artificial Sequence: Synthetic oligonucleotide
ugggggcgcgggauccccg

SEQ ID NO: 13986 - RNA, 19 nt, Artificial Sequence
  Description of Artificial Sequence: Synthetic oligonucleotide
uggggggcgcgggaucccc

SEQ ID NO: 13987 - RNA, 19 nt, Artificial Sequence
  Description of Artificial Sequence: Synthetic oligonucleotide
uaggggggcgcgggauccc

SEQ ID NO: 13988 - RNA, 19 nt, Artificial Sequence
  Description of Artificial Sequence: Synthetic oligonucleotide
ugaggggggcgcgggaucc

SEQ ID NO: 13989 - RNA, 19 nt, Artificial Sequence
  Description of Artificial Sequence: Synthetic oligonucleotide
uggaggggggcgcgggauc

SEQ ID NO: 13990 - RNA, 19 nt, Artificial Sequence
  Description of Artificial Sequence: Synthetic oligonucleotide
uaggaggggggcgcgggau

SEQ ID NO: 13991 - RNA, 19 nt, Artificial Sequence
  Description of Artificial Sequence: Synthetic oligonucleotide
ugaggaggggggcgcggga

SEQ ID NO: 13992 - RNA, 19 nt, Artificial Sequence
  Description of Artificial Sequence: Synthetic oligonucleotide
uugaggaggggggcgcggg

SEQ ID NO: 13993 - RNA, 19 nt, Artificial Sequence
  Description of Artificial Sequence: Synthetic oligonucleotide
ugugaggaggggggcgcgg

SEQ ID NO: 13994 - RNA, 19 nt, Artificial Sequence
  Description of Artificial Sequence: Synthetic oligonucleotide
uagugaggaggggggcgcg

SEQ ID NO: 13995 - RNA, 19 nt, Artificial Sequence
  Description of Artificial Sequence: Synthetic oligonucleotide
uaagugaggaggggggcgc

SEQ ID NO: 13996 - RNA, 19 nt, Artificial Sequence
  Description of Artificial Sequence: Synthetic oligonucleotide
ucaagugaggaggggggcg

SEQ ID NO: 13997 - RNA, 19 nt, Artificial Sequence
  Description of Artificial Sequence: Synthetic oligonucleotide
ugcaagugaggaggggggc

SEQ ID NO: 13998 - RNA, 19 nt, Artificial Sequence
  Description of Artificial Sequence: Synthetic oligonucleotide
ucgcaagugaggagggggg

SEQ ID NO: 13999 - RNA, 19 nt, Artificial Sequence
  Description of Artificial Sequence: Synthetic oligonucleotide
ugcgcaagugaggaggggg

SEQ ID NO: 14000 - RNA, 19 nt, Artificial Sequence
  Description of Artificial Sequence: Synthetic oligonucleotide
uagcgcaagugaggagggg

SEQ ID NO: 14001 - RNA, 19 nt, Artificial Sequence
  Description of Artificial Sequence: Synthetic oligonucleotide
ucagcgcaagugaggaggg

SEQ ID NO: 14002 - RNA, 19 nt, Artificial Sequence
  Description of Artificial Sequence: Synthetic oligonucleotide
ugcagcgcaagugaggagg

SEQ ID NO: 14003 - RNA, 19 nt, Artificial Sequence
  Description of Artificial Sequence: Synthetic oligonucleotide
uagcagcgcaagugaggag

SEQ ID NO: 14004 - RNA, 19 nt, Artificial Sequence
  Description of Artificial Sequence: Synthetic oligonucleotide
ugagcagcgcaagugagga

SEQ ID NO: 14005 - RNA, 19 nt, Artificial Sequence
  Description of Artificial Sequence: Synthetic oligonucleotide
uagagcagcgcaagugagg

SEQ ID NO: 14006 - RNA, 19 nt, Artificial Sequence
  Description of Artificial Sequence: Synthetic oligonucleotide
ugagagcagcgcaagugag

SEQ ID NO: 14007 - RNA, 19 nt, Artificial Sequence
  Description of Artificial Sequence: Synthetic oligonucleotide
ucgagagcagcgcaaguga

SEQ ID NO: 14008 - RNA, 19 nt, Artificial Sequence
  Description of Artificial Sequence: Synthetic oligonucleotide
uccgagagcagcgcaagug

SEQ ID NO: 14009 - RNA, 19 nt, Artificial Sequence
  Description of Artificial Sequence: Synthetic oligonucleotide
uuccgagagcagcgcaagu

SEQ ID NO: 14010 - RNA, 19 nt, Artificial Sequence
  Description of Artificial Sequence: Synthetic oligonucleotide
ucuccgagagcagcgcaag

SEQ ID NO: 14011 - RNA, 19 nt, Artificial Sequence
  Description of Artificial Sequence: Synthetic oligonucleotide
ugcuccgagagcagcgcaa

SEQ ID NO: 14012 - RNA, 19 nt, Artificial Sequence
  Description of Artificial Sequence: Synthetic oligonucleotide
uggcuccgagagcagcgca

SEQ ID NO: 14013 - RNA, 19 nt, Artificial Sequence
  Description of Artificial Sequence: Synthetic oligonucleotide
ugggcuccgagagcagcgc

SEQ ID NO: 14014 - RNA, 19 nt, Artificial Sequence
  Description of Artificial Sequence: Synthetic oligonucleotide
uggggcuccgagagcagcg

SEQ ID NO: 14015 - RNA, 19 nt, Artificial Sequence
  Description of Artificial Sequence: Synthetic oligonucleotide
uuggggcuccgagagcagc

SEQ ID NO: 14016 - RNA, 19 nt, Artificial Sequence
  Description of Artificial Sequence: Synthetic oligonucleotide
ucuggggcuccgagagcag

SEQ ID NO: 14017 - RNA, 19 nt, Artificial Sequence
  Description of Artificial Sequence: Synthetic oligonucleotide
ugcuggggcuccgagagca

SEQ ID NO: 14018 - RNA, 19 nt, Artificial Sequence
  Description of Artificial Sequence: Synthetic oligonucleotide
uggcuggggcuccgagagc

SEQ ID NO: 14019 - RNA, 19 nt, Artificial Sequence
  Description of Artificial Sequence: Synthetic oligonucleotide
ucggcuggggcuccgagag

SEQ ID NO: 14020 - RNA, 19 nt, Artificial Sequence
  Description of Artificial Sequence: Synthetic oligonucleotide
uccggcuggggcuccgaga

SEQ ID NO: 14021 - RNA, 19 nt, Artificial Sequence
  Description of Artificial Sequence: Synthetic oligonucleotide
ugccggcuggggcuccgag

SEQ ID NO: 14022 - RNA, 19 nt, Artificial Sequence
  Description of Artificial Sequence: Synthetic oligonucleotide
uagccggcuggggcuccga

SEQ ID NO: 14023 - RNA, 19 nt, Artificial Sequence
  Description of Artificial Sequence: Synthetic oligonucleotide
ugagccggcuggggcuccg

SEQ ID NO: 14024 - RNA, 19 nt, Artificial Sequence
  Description of Artificial Sequence: Synthetic oligonucleotide
uggagccggcuggggcucc

SEQ ID NO: 14025 - RNA, 19 nt, Artificial Sequence
  Description of Artificial Sequence: Synthetic oligonucleotide
ucggagccggcuggggcuc

SEQ ID NO: 14026 - RNA, 19 nt, Artificial Sequence
  Description of Artificial Sequence: Synthetic oligonucleotide
ugcggagccggcuggggcu

SEQ ID NO: 14027 - RNA, 19 nt, Artificial Sequence
  Description of Artificial Sequence: Synthetic oligonucleotide
uggcggagccggcuggggc

SEQ ID NO: 14028 - RNA, 19 nt, Artificial Sequence
  Description of Artificial Sequence: Synthetic oligonucleotide
ugggcggagccggcugggg

SEQ ID NO: 14029 - RNA, 19 nt, Artificial Sequence
  Description of Artificial Sequence: Synthetic oligonucleotide
ucgggcggagccggcuggg

SEQ ID NO: 14030 - RNA, 19 nt, Artificial Sequence
  Description of Artificial Sequence: Synthetic oligonucleotide
ugcgggcggagccggcugg

SEQ ID NO: 14031 - RNA, 19 nt, Artificial Sequence
  Description of Artificial Sequence: Synthetic oligonucleotide
uagcgggcggagccggcug

SEQ ID NO: 14032 - RNA, 19 nt, Artificial Sequence
  Description of Artificial Sequence: Synthetic oligonucleotide
uaagcgggcggagccggcu

SEQ ID NO: 14033 - RNA, 19 nt, Artificial Sequence
  Description of Artificial Sequence: Synthetic oligonucleotide
ugaagcgggcggagccggc

SEQ ID NO: 14034 - RNA, 19 nt, Artificial Sequence
  Description of Artificial Sequence: Synthetic oligonucleotide
ucgaagcgggcggagccgg

SEQ ID NO: 14035 - RNA, 19 nt, Artificial Sequence
  Description of Artificial Sequence: Synthetic oligonucleotide
uccgaagcgggcggagccg

SEQ ID NO: 14036 - RNA, 19 nt, Artificial Sequence
  Description of Artificial Sequence: Synthetic oligonucleotide
ugccgaagcgggcggagcc

SEQ ID NO: 14037 - RNA, 19 nt, Artificial Sequence
  Description of Artificial Sequence: Synthetic oligonucleotide
ucgccgaagcgggcggagc

SEQ ID NO: 14038 - RNA, 19 nt, Artificial Sequence
  Description of Artificial Sequence: Synthetic oligonucleotide
uccgccgaagcgggcggag

SEQ ID NO: 14039 - RNA, 19 nt, Artificial Sequence
  Description of Artificial Sequence: Synthetic oligonucleotide
uaccgccgaagcgggcgga

SEQ ID NO: 14040 - RNA, 19 nt, Artificial Sequence
  Description of Artificial Sequence: Synthetic oligonucleotide
uaaccgccgaagcgggcgg

SEQ ID NO: 14041 - RNA, 19 nt, Artificial Sequence
  Description of Artificial Sequence: Synthetic oligonucleotide
uaaaccgccgaagcgggcg

SEQ ID NO: 14042 - RNA, 19 nt, Artificial Sequence
  Description of Artificial Sequence: Synthetic oligonucleotide
ucaaaccgccgaagcgggc

SEQ ID NO: 14043 - RNA, 19 nt, Artificial Sequence
  Description of Artificial Sequence: Synthetic oligonucleotide
uccaaaccgccgaagcggg

SEQ ID NO: 14044 - RNA, 19 nt, Artificial Sequence
  Description of Artificial Sequence: Synthetic oligonucleotide
uuccaaaccgccgaagcgg

SEQ ID NO: 14045 - RNA, 19 nt, Artificial Sequence
  Description of Artificial Sequence: Synthetic oligonucleotide
uauccaaaccgccgaagcg

SEQ ID NO: 14046 - RNA, 19 nt, Artificial Sequence
  Description of Artificial Sequence: Synthetic oligonucleotide
uuauccaaaccgccgaagc

SEQ ID NO: 14047 - RNA, 19 nt, Artificial Sequence
  Description of Artificial Sequence: Synthetic oligonucleotide
uauauccaaaccgccgaag

SEQ ID NO: 14048 - RNA, 19 nt, Artificial Sequence
  Description of Artificial Sequence: Synthetic oligonucleotide
uaauauccaaaccgccgaa

SEQ ID NO: 14049 - RNA, 19 nt, Artificial Sequence
  Description of Artificial Sequence: Synthetic oligonucleotide
uaaauauccaaaccgccga

SEQ ID NO: 14050 - RNA, 19 nt, Artificial Sequence
  Description of Artificial Sequence: Synthetic oligonucleotide
uuaaauauccaaaccgccg

SEQ ID NO: 14051 - RNA, 19 nt, Artificial Sequence
  Description of Artificial Sequence: Synthetic oligonucleotide
uauaaauauccaaaccgcc

SEQ ID NO: 14052 - RNA, 19 nt, Artificial Sequence
  Description of Artificial Sequence: Synthetic oligonucleotide
uaauaaauauccaaaccgc

SEQ ID NO: 14053 - RNA, 19 nt, Artificial Sequence
  Description of Artificial Sequence: Synthetic oligonucleotide
ucaauaaauauccaaaccg

SEQ ID NO: 14054 - RNA, 19 nt, Artificial Sequence
  Description of Artificial Sequence: Synthetic oligonucleotide
uucaauaaauauccaaacc

SEQ ID NO: 14055 - RNA, 19 nt, Artificial Sequence
  Description of Artificial Sequence: Synthetic oligonucleotide
ugucaauaaauauccaaac

SEQ ID NO: 14056 - RNA, 19 nt, Artificial Sequence
  Description of Artificial Sequence: Synthetic oligonucleotide
uggucaauaaauauccaaa

SEQ ID NO: 14057 - RNA, 19 nt, Artificial Sequence
  Description of Artificial Sequence: Synthetic oligonucleotide
uaggucaauaaauauccaa

SEQ ID NO: 14058 - RNA, 19 nt, Artificial Sequence
  Description of Artificial Sequence: Synthetic oligonucleotide
ugaggucaauaaauaucca

SEQ ID NO: 14059 - RNA, 19 nt, Artificial Sequence
  Description of Artificial Sequence: Synthetic oligonucleotide
ucgaggucaauaaauaucc

SEQ ID NO: 14060 - RNA, 19 nt, Artificial Sequence
  Description of Artificial Sequence: Synthetic oligonucleotide
uacgaggucaauaaauauc

SEQ ID NO: 14061 - RNA, 19 nt, Artificial Sequence
  Description of Artificial Sequence: Synthetic oligonucleotide
ugacgaggucaauaaauau

SEQ ID NO: 14062 - RNA, 19 nt, Artificial Sequence
  Description of Artificial Sequence: Synthetic oligonucleotide
uggacgaggucaauaaaua

SEQ ID NO: 14063 - RNA, 19 nt, Artificial Sequence
  Description of Artificial Sequence: Synthetic oligonucleotide
uaggacgaggucaauaaau

SEQ ID NO: 14064 - RNA, 19 nt, Artificial Sequence
  Description of Artificial Sequence: Synthetic oligonucleotide
ugaggacgaggucaauaaa

SEQ ID NO: 14065 - RNA, 19 nt, Artificial Sequence
  Description of Artificial Sequence: Synthetic oligonucleotide
uggaggacgaggucaauaa

SEQ ID NO: 14066 - RNA, 19 nt, Artificial Sequence
  Description of Artificial Sequence: Synthetic oligonucleotide
ucggaggacgaggucaaua

SEQ ID NO: 14067 - RNA, 19 nt, Artificial Sequence
  Description of Artificial Sequence: Synthetic oligonucleotide
uucggaggacgaggucaau

SEQ ID NO: 14068 - RNA, 19 nt, Artificial Sequence
  Description of Artificial Sequence: Synthetic oligonucleotide
ugucggaggacgaggucaa

SEQ ID NO: 14069 - RNA, 19 nt, Artificial Sequence
  Description of Artificial Sequence: Synthetic oligonucleotide
uagucggaggacgagguca

SEQ ID NO: 14070 - RNA, 19 nt, Artificial Sequence
  Description of Artificial Sequence: Synthetic oligonucleotide
ugagucggaggacgagguc

SEQ ID NO: 14071 - RNA, 19 nt, Artificial Sequence
  Description of Artificial Sequence: Synthetic oligonucleotide
ucgagucggaggacgaggu

SEQ ID NO: 14072 - RNA, 19 nt, Artificial Sequence
  Description of Artificial Sequence: Synthetic oligonucleotide
ugcgagucggaggacgagg

SEQ ID NO: 14073 - RNA, 19 nt, Artificial Sequence
  Description of Artificial Sequence: Synthetic oligonucleotide
uagcgagucggaggacgag

SEQ ID NO: 14074 - RNA, 19 nt, Artificial Sequence
  Description of Artificial Sequence: Synthetic oligonucleotide
ucagcgagucggaggacga

SEQ ID NO: 14075 - RNA, 19 nt, Artificial Sequence
  Description of Artificial Sequence: Synthetic oligonucleotide
uucagcgagucggaggacg

SEQ ID NO: 14076 - RNA, 19 nt, Artificial Sequence
  Description of Artificial Sequence: Synthetic oligonucleotide
ugucagcgagucggaggac

SEQ ID NO: 14077 - RNA, 19 nt, Artificial Sequence
  Description of Artificial Sequence: Synthetic oligonucleotide
uugucagcgagucggagga

SEQ ID NO: 14078 - RNA, 19 nt, Artificial Sequence
  Description of Artificial Sequence: Synthetic oligonucleotide
ucugucagcgagucggagg

SEQ ID NO: 14079 - RNA, 19 nt, Artificial Sequence
  Description of Artificial Sequence: Synthetic oligonucleotide
uccugucagcgagucggag

SEQ ID NO: 14080 - RNA, 19 nt, Artificial Sequence
  Description of Artificial Sequence: Synthetic oligonucleotide
ugccugucagcgagucgga

SEQ ID NO: 14081 - RNA, 19 nt, Artificial Sequence
  Description of Artificial Sequence: Synthetic oligonucleotide
uagccugucagcgagucgg

SEQ ID NO: 14082 - RNA, 19 nt, Artificial Sequence
  Description of Artificial Sequence: Synthetic oligonucleotide
uuagccugucagcgagucg

SEQ ID NO: 14083 - RNA, 19 nt, Artificial Sequence
  Description of Artificial Sequence: Synthetic oligonucleotide
uguagccugucagcgaguc

SEQ ID NO: 14084 - RNA, 19 nt, Artificial Sequence
  Description of Artificial Sequence: Synthetic oligonucleotide
uuguagccugucagcgagu

SEQ ID NO: 14085 - RNA, 19 nt, Artificial Sequence
  Description of Artificial Sequence: Synthetic oligonucleotide
ucuguagccugucagcgag

SEQ ID NO: 14086 - RNA, 19 nt, Artificial Sequence
  Description of Artificial Sequence: Synthetic oligonucleotide
uccuguagccugucagcga

SEQ ID NO: 14087 - RNA, 19 nt, Artificial Sequence
  Description of Artificial Sequence: Synthetic oligonucleotide
uuccuguagccugucagcg

SEQ ID NO: 14088 - RNA, 19 nt, Artificial Sequence
  Description of Artificial Sequence: Synthetic oligonucleotide
uguccuguagccugucagc

SEQ ID NO: 14089 - RNA, 19 nt, Artificial Sequence
  Description of Artificial Sequence: Synthetic oligonucleotide
ugguccuguagccugucag

SEQ ID NO: 14090 - RNA, 19 nt, Artificial Sequence
  Description of Artificial Sequence: Synthetic oligonucleotide
uggguccuguagccuguca

SEQ ID NO: 14091 - RNA, 19 nt, Artificial Sequence
  Description of Artificial Sequence: Synthetic oligonucleotide
ugggguccuguagccuguc

SEQ ID NO: 14092 - RNA, 19 nt, Artificial Sequence
  Description of Artificial Sequence: Synthetic oligonucleotide
uggggguccuguagccugu

SEQ ID NO: 14093 - RNA, 19 nt, Artificial Sequence
  Description of Artificial Sequence: Synthetic oligonucleotide
uuggggguccuguagccug

SEQ ID NO: 14094 - RNA, 19 nt, Artificial Sequence
  Description of Artificial Sequence: Synthetic oligonucleotide
uuuggggguccuguagccu

SEQ ID NO: 14095 - RNA, 19 nt, Artificial Sequence
  Description of Artificial Sequence: Synthetic oligonucleotide
uguuggggguccuguagcc

SEQ ID NO: 14096 - RNA, 19 nt, Artificial Sequence
  Description of Artificial Sequence: Synthetic oligonucleotide
uuguuggggguccuguagc

SEQ ID NO: 14097 - RNA, 19 nt, Artificial Sequence
  Description of Artificial Sequence: Synthetic oligonucleotide
uuuguuggggguccuguag

SEQ ID NO: 14098 - RNA, 19 nt, Artificial Sequence
  Description of Artificial Sequence: Synthetic oligonucleotide
uguuguuggggguccugua

SEQ ID NO: 14099 - RNA, 19 nt, Artificial Sequence
  Description of Artificial Sequence: Synthetic oligonucleotide
ugguuguuggggguccugu

SEQ ID NO: 14100 - RNA, 19 nt, Artificial Sequence
  Description of Artificial Sequence: Synthetic oligonucleotide
uggguuguuggggguccug

SEQ ID NO: 14101 - RNA, 19 nt, Artificial Sequence
  Description of Artificial Sequence: Synthetic oligonucleotide
ugggguuguuggggguccu

SEQ ID NO: 14102 - RNA, 19 nt, Artificial Sequence
  Description of Artificial Sequence: Synthetic oligonucleotide
uugggguuguugggggucc

SEQ ID NO: 14103 - RNA, 19 nt, Artificial Sequence
  Description of Artificial Sequence: Synthetic oligonucleotide
uuugggguuguuggggguc

SEQ ID NO: 14104 - RNA, 19 nt, Artificial Sequence
  Description of Artificial Sequence: Synthetic oligonucleotide
uauugggguuguugggggu

SEQ ID NO: 14105 - RNA, 19 nt, Artificial Sequence
  Description of Artificial Sequence: Synthetic oligonucleotide
ugauugggguuguuggggg

SEQ ID NO: 14106 - RNA, 19 nt, Artificial Sequence
  Description of Artificial Sequence: Synthetic oligonucleotide
uggauugggguuguugggg

SEQ ID NO: 14107 - RNA, 19 nt, Artificial Sequence
  Description of Artificial Sequence: Synthetic oligonucleotide
uuggauugggguuguuggg

SEQ ID NO: 14108 - RNA, 19 nt, Artificial Sequence
  Description of Artificial Sequence: Synthetic oligonucleotide
uguggauugggguuguugg

SEQ ID NO: 14109 - RNA, 19 nt, Artificial Sequence
  Description of Artificial Sequence: Synthetic oligonucleotide
ucguggauugggguuguug

SEQ ID NO: 14110 - RNA, 19 nt, Artificial Sequence
  Description of Artificial Sequence: Synthetic oligonucleotide
uacguggauugggguuguu

SEQ ID NO: 14111 - RNA, 19 nt, Artificial Sequence
  Description of Artificial Sequence: Synthetic oligonucleotide
uaacguggauugggguugu

SEQ ID NO: 14112 - RNA, 19 nt, Artificial Sequence
  Description of Artificial Sequence: Synthetic oligonucleotide
uaaacguggauugggguug

SEQ ID NO: 14113 - RNA, 19 nt, Artificial Sequence
  Description of Artificial Sequence: Synthetic oligonucleotide
uaaaacguggauugggguu

SEQ ID NO: 14114 - RNA, 19 nt, Artificial Sequence
  Description of Artificial Sequence: Synthetic oligonucleotide
ucaaaacguggauuggggu

SEQ ID NO: 14115 - RNA, 19 nt, Artificial Sequence
  Description of Artificial Sequence: Synthetic oligonucleotide
uccaaaacguggauugggg

SEQ ID NO: 14116 - RNA, 19 nt, Artificial Sequence
  Description of Artificial Sequence: Synthetic oligonucleotide
uuccaaaacguggauuggg

SEQ ID NO: 14117 - RNA, 19 nt, Artificial Sequence
  Description of Artificial Sequence: Synthetic oligonucleotide
uauccaaaacguggauugg

SEQ ID NO: 14118 - RNA, 19 nt, Artificial Sequence
  Description of Artificial Sequence: Synthetic oligonucleotide
ucauccaaaacguggauug

SEQ ID NO: 14119 - RNA, 19 nt, Artificial Sequence
  Description of Artificial Sequence: Synthetic oligonucleotide
ugcauccaaaacguggauu

SEQ ID NO: 14120 - RNA, 19 nt, Artificial Sequence
  Description of Artificial Sequence: Synthetic oligonucleotide
uugcauccaaaacguggau

SEQ ID NO: 14121 - RNA, 19 nt, Artificial Sequence
  Description of Artificial Sequence: Synthetic oligonucleotide
ugugcauccaaaacgugga

SEQ ID NO: 14122 - RNA, 19 nt, Artificial Sequence
  Description of Artificial Sequence: Synthetic oligonucleotide
uagugcauccaaaacgugg

SEQ ID NO: 14123 - RNA, 19 nt, Artificial Sequence
  Description of Artificial Sequence: Synthetic oligonucleotide
ucagugcauccaaaacgug

SEQ ID NO: 14124 - RNA, 19 nt, Artificial Sequence
  Description of Artificial Sequence: Synthetic oligonucleotide
uucagugcauccaaaacgu

SEQ ID NO: 14125 - RNA, 19 nt, Artificial Sequence
  Description of Artificial Sequence: Synthetic oligonucleotide
ucucagugcauccaaaacg

SEQ ID NO: 14126 - RNA, 19 nt, Artificial Sequence
  Description of Artificial Sequence: Synthetic oligonucleotide
uucucagugcauccaaaac

SEQ ID NO: 14127 - RNA, 19 nt, Artificial Sequence
  Description of Artificial Sequence: Synthetic oligonucleotide
ugucucagugcauccaaaa

SEQ ID NO: 14128 - RNA, 19 nt, Artificial Sequence
  Description of Artificial Sequence: Synthetic oligonucleotide
uggucucagugcauccaaa

SEQ ID NO: 14129 - RNA, 19 nt, Artificial Sequence
  Description of Artificial Sequence: Synthetic oligonucleotide
ugggucucagugcauccaa

SEQ ID NO: 14130 - RNA, 19 nt, Artificial Sequence
  Description of Artificial Sequence: Synthetic oligonucleotide
uggggucucagugcaucca

SEQ ID NO: 14131 - RNA, 19 nt, Artificial Sequence
  Description of Artificial Sequence: Synthetic oligonucleotide
ucggggucucagugcaucc

SEQ ID NO: 14132 - RNA, 19 nt, Artificial Sequence
  Description of Artificial Sequence: Synthetic oligonucleotide
uucggggucucagugcauc

SEQ ID NO: 14133 - RNA, 19 nt, Artificial Sequence
  Description of Artificial Sequence: Synthetic oligonucleotide
ugucggggucucagugcau

SEQ ID NO: 14134 - RNA, 19 nt, Artificial Sequence
  Description of Artificial Sequence: Synthetic oligonucleotide
uugucggggucucagugca

SEQ ID NO: 14135 - RNA, 19 nt, Artificial Sequence
  Description of Artificial Sequence: Synthetic oligonucleotide
uaugucggggucucagugc

SEQ ID NO: 14136 - RNA, 19 nt, Artificial Sequence
  Description of Artificial Sequence: Synthetic oligonucleotide
uaaugucggggucucagug

SEQ ID NO: 14137 - RNA, 19 nt, Artificial Sequence
  Description of Artificial Sequence: Synthetic oligonucleotide
ugaaugucggggucucagu

SEQ ID NO: 14138 - RNA, 19 nt, Artificial Sequence
  Description of Artificial Sequence: Synthetic oligonucleotide
uggaaugucggggucucag

SEQ ID NO: 14139 - RNA, 19 nt, Artificial Sequence
  Description of Artificial Sequence: Synthetic oligonucleotide
uaggaaugucggggucuca

SEQ ID NO: 14140 - RNA, 19 nt, Artificial Sequence
  Description of Artificial Sequence: Synthetic oligonucleotide
ugaggaaugucggggucuc

SEQ ID NO: 14141 - RNA, 19 nt, Artificial Sequence
  Description of Artificial Sequence: Synthetic oligonucleotide
ucgaggaaugucggggucu

SEQ ID NO: 14142 - RNA, 19 nt, Artificial Sequence
  Description of Artificial Sequence: Synthetic oligonucleotide
uccgaggaaugucgggguc

SEQ ID NO: 14143 - RNA, 19 nt, Artificial Sequence
  Description of Artificial Sequence: Synthetic oligonucleotide
uaccgaggaaugucggggu

SEQ ID NO: 14144 - RNA, 19 nt, Artificial Sequence
  Description of Artificial Sequence: Synthetic oligonucleotide
uuaccgaggaaugucgggg

SEQ ID NO: 14145 - RNA, 19 nt, Artificial Sequence
  Description of Artificial Sequence: Synthetic oligonucleotide
uauaccgaggaaugucggg

SEQ ID NO: 14146 - RNA, 19 nt, Artificial Sequence
  Description of Artificial Sequence: Synthetic oligonucleotide
uaauaccgaggaaugucgg

SEQ ID NO: 14147 - RNA, 19 nt, Artificial Sequence
  Description of Artificial Sequence: Synthetic oligonucleotide
uaaauaccgaggaaugucg

SEQ ID NO: 14148 - RNA, 19 nt, Artificial Sequence
  Description of Artificial Sequence: Synthetic oligonucleotide
uuaaauaccgaggaauguc

SEQ ID NO: 14149 - RNA, 19 nt, Artificial Sequence
  Description of Artificial Sequence: Synthetic oligonucleotide
uauaaauaccgaggaaugu

SEQ ID NO: 14150 - RNA, 19 nt, Artificial Sequence
  Description of Artificial Sequence: Synthetic oligonucleotide
uaauaaauaccgaggaaug

SEQ ID NO: 14151 - RNA, 19 nt, Artificial Sequence
  Description of Artificial Sequence: Synthetic oligonucleotide
ucaauaaauaccgaggaau

SEQ ID NO: 14152 - RNA, 19 nt, Artificial Sequence
  Description of Artificial Sequence: Synthetic oligonucleotide
uacaauaaauaccgaggaa

SEQ ID NO: 14153 - RNA, 19 nt, Artificial Sequence
  Description of Artificial Sequence: Synthetic oligonucleotide
ugacaauaaauaccgagga

SEQ ID NO: 14154 - RNA, 19 nt, Artificial Sequence
  Description of Artificial Sequence: Synthetic oligonucleotide
uagacaauaaauaccgagg

SEQ ID NO: 14155 - RNA, 19 nt, Artificial Sequence
  Description of Artificial Sequence: Synthetic oligonucleotide
ucagacaauaaauaccgag

SEQ ID NO: 14156 - RNA, 19 nt, Artificial Sequence
  Description of Artificial Sequence: Synthetic oligonucleotide
uacagacaauaaauaccga

SEQ ID NO: 14157 - RNA, 19 nt, Artificial Sequence
  Description of Artificial Sequence: Synthetic oligonucleotide
ugacagacaauaaauaccg

SEQ ID NO: 14158 - RNA, 19 nt, Artificial Sequence
  Description of Artificial Sequence: Synthetic oligonucleotide
uggacagacaauaaauacc

SEQ ID NO: 14159 - RNA, 19 nt, Artificial Sequence
  Description of Artificial Sequence: Synthetic oligonucleotide
ugggacagacaauaaauac

SEQ ID NO: 14160 - RNA, 19 nt, Artificial Sequence
  Description of Artificial Sequence: Synthetic oligonucleotide
uggggacagacaauaaaua

SEQ ID NO: 14161 - RNA, 19 nt, Artificial Sequence
  Description of Artificial Sequence: Synthetic oligonucleotide
uuggggacagacaauaaau

SEQ ID NO: 14162 - RNA, 19 nt, Artificial Sequence
  Description of Artificial Sequence: Synthetic oligonucleotide
uguggggacagacaauaaa

SEQ ID NO: 14163 - RNA, 19 nt, Artificial Sequence
  Description of Artificial Sequence: Synthetic oligonucleotide
ugguggggacagacaauaa

SEQ ID NO: 14164 - RNA, 19 nt, Artificial Sequence
  Description of Artificial Sequence: Synthetic oligonucleotide
uagguggggacagacaaua

SEQ ID NO: 14165 - RNA, 19 nt, Artificial Sequence
  Description of Artificial Sequence: Synthetic oligonucleotide
uuagguggggacagacaau

SEQ ID NO: 14166 - RNA, 19 nt, Artificial Sequence
  Description of Artificial Sequence: Synthetic oligonucleotide
ucuagguggggacagacaa

SEQ ID NO: 14167 - RNA, 19 nt, Artificial Sequence
  Description of Artificial Sequence: Synthetic oligonucleotide
uccuagguggggacagaca

SEQ ID NO: 14168 - RNA, 19 nt, Artificial Sequence
  Description of Artificial Sequence: Synthetic oligonucleotide
uuccuagguggggacagac

SEQ ID NO: 14169 - RNA, 19 nt, Artificial Sequence
  Description of Artificial Sequence: Synthetic oligonucleotide
uguccuagguggggacaga

SEQ ID NO: 14170 - RNA, 19 nt, Artificial Sequence
  Description of Artificial Sequence: Synthetic oligonucleotide
ugguccuagguggggacag

SEQ ID NO: 14171 - RNA, 19 nt, Artificial Sequence
  Description of Artificial Sequence: Synthetic oligonucleotide
uggguccuagguggggaca

SEQ ID NO: 14172 - RNA, 19 nt, Artificial Sequence
  Description of Artificial Sequence: Synthetic oligonucleotide
ugggguccuagguggggac

SEQ ID NO: 14173 - RNA, 19 nt, Artificial Sequence
  Description of Artificial Sequence: Synthetic oligonucleotide
uggggguccuaggugggga

SEQ ID NO: 14174 - RNA, 19 nt, Artificial Sequence
  Description of Artificial Sequence: Synthetic oligonucleotide
uuggggguccuaggugggg

SEQ ID NO: 14175 - RNA, 19 nt, Artificial Sequence
  Description of Artificial Sequence: Synthetic oligonucleotide
uguggggguccuagguggg

SEQ ID NO: 14176 - RNA, 19 nt, Artificial Sequence
  Description of Artificial Sequence: Synthetic oligonucleotide
ugguggggguccuaggugg

SEQ ID NO: 14177 - RNA, 19 nt, Artificial Sequence
  Description of Artificial Sequence: Synthetic oligonucleotide
uggguggggguccuaggug

SEQ ID NO: 14178 - RNA, 19 nt, Artificial Sequence
  Description of Artificial Sequence: Synthetic oligonucleotide
ugggguggggguccuaggu

SEQ ID NO: 14179 - RNA, 19 nt, Artificial Sequence
  Description of Artificial Sequence: Synthetic oligonucleotide
uggggguggggguccuagg

SEQ ID NO: 14180 - RNA, 19 nt, Artificial Sequence
  Description of Artificial Sequence: Synthetic oligonucleotide
ucggggguggggguccuag

SEQ ID NO: 14181 - RNA, 19 nt, Artificial Sequence
  Description of Artificial Sequence: Synthetic oligonucleotide
uucggggguggggguccua

SEQ ID NO: 14182 - RNA, 19 nt, Artificial Sequence
  Description of Artificial Sequence: Synthetic oligonucleotide
ugucggggguggggguccu

SEQ ID NO: 14183 - RNA, 19 nt, Artificial Sequence
  Description of Artificial Sequence: Synthetic oligonucleotide
uggucgggggugggggucc

SEQ ID NO: 14184 - RNA, 19 nt, Artificial Sequence
  Description of Artificial Sequence: Synthetic oligonucleotide
ugggucggggguggggguc

SEQ ID NO: 14185 - RNA, 19 nt, Artificial Sequence
  Description of Artificial Sequence: Synthetic oligonucleotide
uagggucgggggugggggu

SEQ ID NO: 14186 - RNA, 19 nt, Artificial Sequence
  Description of Artificial Sequence: Synthetic oligonucleotide
ugagggucggggguggggg

SEQ ID NO: 14187 - RNA, 19 nt, Artificial Sequence
  Description of Artificial Sequence: Synthetic oligonucleotide
ucgagggucgggggugggg

SEQ ID NO: 14188 - RNA, 19 nt, Artificial Sequence
  Description of Artificial Sequence: Synthetic oligonucleotide
ugcgagggucggggguggg

SEQ ID NO: 14189 - RNA, 19 nt, Artificial Sequence
  Description of Artificial Sequence: Synthetic oligonucleotide
ucgcgagggucgggggugg

SEQ ID NO: 14190 - RNA, 19 nt, Artificial Sequence
  Description of Artificial Sequence: Synthetic oligonucleotide
uucgcgagggucgggggug

SEQ ID NO: 14191 - RNA, 19 nt, Artificial Sequence
  Description of Artificial Sequence: Synthetic oligonucleotide
uuucgcgagggucgggggu

SEQ ID NO: 14192 - RNA, 19 nt, Artificial Sequence
  Description of Artificial Sequence: Synthetic oligonucleotide
uauucgcgagggucggggg

SEQ ID NO: 14193 - RNA, 19 nt, Artificial Sequence
  Description of Artificial Sequence: Synthetic oligonucleotide
uuauucgcgagggucgggg

SEQ ID NO: 14194 - RNA, 19 nt, Artificial Sequence
  Description of Artificial Sequence: Synthetic oligonucleotide
uuuauucgcgagggucggg

SEQ ID NO: 14195 - RNA, 19 nt, Artificial Sequence
  Description of Artificial Sequence: Synthetic oligonucleotide
uuuuauucgcgagggucgg

SEQ ID NO: 14196 - RNA, 19 nt, Artificial Sequence
  Description of Artificial Sequence: Synthetic oligonucleotide
uuuuuauucgcgagggucg

SEQ ID NO: 14197 - RNA, 19 nt, Artificial Sequence
  Description of Artificial Sequence: Synthetic oligonucleotide
ucuuuuauucgcgaggguc

SEQ ID NO: 14198 - RNA, 19 nt, Artificial Sequence
  Description of Artificial Sequence: Synthetic oligonucleotide
uccuuuuauucgcgagggu

SEQ ID NO: 14199 - RNA, 19 nt, Artificial Sequence
  Description of Artificial Sequence: Synthetic oligonucleotide
ugccuuuuauucgcgaggg

SEQ ID NO: 14200 - RNA, 19 nt, Artificial Sequence
  Description of Artificial Sequence: Synthetic oligonucleotide
uggccuuuuauucgcgagg

SEQ ID NO: 14201 - RNA, 19 nt, Artificial Sequence
  Description of Artificial Sequence: Synthetic oligonucleotide
ugggccuuuuauucgcgag

SEQ ID NO: 14202 - RNA, 19 nt, Artificial Sequence
  Description of Artificial Sequence: Synthetic oligonucleotide
uagggccuuuuauucgcga

SEQ ID NO: 14203 - RNA, 19 nt, Artificial Sequence
  Description of Artificial Sequence: Synthetic oligonucleotide
ugagggccuuuuauucgcg

SEQ ID NO: 14204 - RNA, 19 nt, Artificial Sequence
  Description of Artificial Sequence: Synthetic oligonucleotide
uggagggccuuuuauucgc

SEQ ID NO: 14205 - RNA, 19 nt, Artificial Sequence
  Description of Artificial Sequence: Synthetic oligonucleotide
uuggagggccuuuuauucg

SEQ ID NO: 14206 - RNA, 19 nt, Artificial Sequence
  Description of Artificial Sequence: Synthetic oligonucleotide
uauggagggccuuuuauuc

SEQ ID NO: 14207 - RNA, 19 nt, Artificial Sequence
  Description of Artificial Sequence: Synthetic oligonucleotide
ugauggagggccuuuuauu

SEQ ID NO: 14208 - RNA, 19 nt, Artificial Sequence
  Description of Artificial Sequence: Synthetic oligonucleotide
uagauggagggccuuuuau

SEQ ID NO: 14209 - RNA, 19 nt, Artificial Sequence
  Description of Artificial Sequence: Synthetic oligonucleotide
ucagauggagggccuuuua

SEQ ID NO: 14210 - RNA, 19 nt, Artificial Sequence
  Description of Artificial Sequence: Synthetic oligonucleotide
ugcagauggagggccuuuu

SEQ ID NO: 14211 - RNA, 19 nt, Artificial Sequence
  Description of Artificial Sequence: Synthetic oligonucleotide
uggcagauggagggccuuu

SEQ ID NO: 14212 - RNA, 19 nt, Artificial Sequence
  Description of Artificial Sequence: Synthetic oligonucleotide
ugggcagauggagggccuu

SEQ ID NO: 14213 - RNA, 19 nt, Artificial Sequence
  Description of Artificial Sequence: Synthetic oligonucleotide
uugggcagauggagggccu

SEQ ID NO: 14214 - RNA, 19 nt, Artificial Sequence
  Description of Artificial Sequence: Synthetic oligonucleotide
uuugggcagauggagggcc

SEQ ID NO: 14215 - RNA, 19 nt, Artificial Sequence
  Description of Artificial Sequence: Synthetic oligonucleotide
uuuugggcagauggagggc

SEQ ID NO: 14216 - RNA, 19 nt, Artificial Sequence
  Description of Artificial Sequence: Synthetic oligonucleotide
ucuuugggcagauggaggg

SEQ ID NO: 14217 - RNA, 19 nt, Artificial Sequence
  Description of Artificial Sequence: Synthetic oligonucleotide
ugcuuugggcagauggagg

SEQ ID NO: 14218 - RNA, 19 nt, Artificial Sequence
  Description of Artificial Sequence: Synthetic oligonucleotide
uagcuuugggcagauggag

SEQ ID NO: 14219 - RNA, 19 nt, Artificial Sequence
  Description of Artificial Sequence: Synthetic oligonucleotide
ugagcuuugggcagaugga

SEQ ID NO: 14220 - RNA, 19 nt, Artificial Sequence
  Description of Artificial Sequence: Synthetic oligonucleotide
uagagcuuugggcagaugg

SEQ ID NO: 14221 - RNA, 19 nt, Artificial Sequence
  Description of Artificial Sequence: Synthetic oligonucleotide
ucagagcuuugggcagaug

SEQ ID NO: 14222 - RNA, 19 nt, Artificial Sequence
  Description of Artificial Sequence: Synthetic oligonucleotide
uccagagcuuugggcagau

SEQ ID NO: 14223 - protein, 4 aa, Artificial Sequence
  Description of Artificial Sequence: Synthetic peptide
GGFG

SEQ ID NO: 14224 - protein, 4 aa, Artificial Sequence
  Description of Artificial Sequence: Synthetic peptide
ALAL

SEQ ID NO: 14225 - protein, 4 aa, Artificial Sequence
  Description of Artificial Sequence: Synthetic peptide
GFLG

SEQ ID NO: 14226 - RNA, 21 nt, Artificial Sequence
  Description of Artificial Sequence: Synthetic oligonucleotide
uuauuauuuguucuuugccuu

SEQ ID NO: 14227 - RNA, 21 nt, Artificial Sequence
  Description of Artificial Sequence: Synthetic oligonucleotide
uuaaaaucuacagucauaguu

SEQ ID NO: 14228 - RNA, 21 nt, Artificial Sequence
  Description of Artificial Sequence: Synthetic oligonucleotide
uaucgacguguccagcuaguu

SEQ ID NO: 14229 - RNA, 21 nt, Artificial Sequence
  Description of Artificial Sequence: Synthetic oligonucleotide
uuacauuaaagucuguuguuu

SEQ ID NO: 14230 - RNA, 21 nt, Artificial Sequence
  Description of Artificial Sequence: Synthetic oligonucleotide
ucuacguaguugaaucuucuu

SEQ ID NO: 14231 - RNA, 21 nt, Artificial Sequence
  Description of Artificial Sequence: Synthetic oligonucleotide
uuucgcaccaacguagaaauu

SEQ ID NO: 14232 - RNA, 21 nt, Artificial Sequence
  Description of Artificial Sequence: Synthetic oligonucleotide
ucgugagacaguagauguuuu

SEQ ID NO: 14233 - RNA, 21 nt, Artificial Sequence
  Description of Artificial Sequence: Synthetic oligonucleotide
ucacacgugagacaguagauu

SEQ ID NO: 14234 - RNA, 21 nt, Artificial Sequence
  Description of Artificial Sequence: Synthetic oligonucleotide
uucacacgugagacaguaguu

SEQ ID NO: 14235 - RNA, 21 nt, Artificial Sequence
  Description of Artificial Sequence: Synthetic oligonucleotide
uaauauuucauuucgcaccuu

SEQ ID NO: 14236 - RNA, 21 nt, Artificial Sequence
  Description of Artificial Sequence: Synthetic oligonucleotide
uaagcaccaaauuggcauauu

SEQ ID NO: 14237 - RNA, 21 nt, Artificial Sequence
  Description of Artificial Sequence: Synthetic oligonucleotide
ucguaguuaaaucuucugguu

SEQ ID NO: 14238 - RNA, 21 nt, Artificial Sequence
  Description of Artificial Sequence: Synthetic oligonucleotide
uuggguaacaucguacaaguu

SEQ ID NO: 14239 - RNA, 21 nt, Artificial Sequence
  Description of Artificial Sequence: Synthetic oligonucleotide
uuauuauuuguucuuugccuu

SEQ ID NO: 14240 - RNA, 19 nt, Artificial Sequence
  Description of Artificial Sequence: Synthetic oligonucleotide
ggcaaagaacaaauaauaa

SEQ ID NO: 14241 - RNA, 21 nt, Artificial Sequence
  Description of Artificial Sequence: Synthetic oligonucleotide
uuauuauuuguucuuugccuu

SEQ ID NO: 14242 - RNA, 19 nt, Artificial Sequence
  Description of Artificial Sequence: Synthetic oligonucleotide
ggcaaagaacaaauaauaa

SEQ ID NO: 14243 - RNA, 21 nt, Artificial Sequence
  Description of Artificial Sequence: Synthetic oligonucleotide
uuauuauuuguucuuugccuu

SEQ ID NO: 14244 - RNA, 19 nt, Artificial Sequence
  Description of Artificial Sequence: Synthetic oligonucleotide
ggcaaagaacaaauaauaa

SEQ ID NO: 14245 - RNA, 21 nt, Artificial Sequence
  Description of Artificial Sequence: Synthetic oligonucleotide
uuauuauuuguucuuugccuu

SEQ ID NO: 14246 - RNA, 19 nt, Artificial Sequence
  Description of Artificial Sequence: Synthetic oligonucleotide
ggcaaagaacaaauaauaa

SEQ ID NO: 14247 - RNA, 21 nt, Artificial Sequence
  Description of Artificial Sequence: Synthetic oligonucleotide
uuauuauuuguucuuugccuu

SEQ ID NO: 14248 - RNA, 19 nt, Artificial Sequence
  Description of Artificial Sequence: Synthetic oligonucleotide
ggcaaagaacaaauaauaa

SEQ ID NO: 14249 - RNA, 21 nt, Artificial Sequence
  Description of Artificial Sequence: Synthetic oligonucleotide
uuauuauuuguucuuugccuu

SEQ ID NO: 14250 - RNA, 19 nt, Artificial Sequence
  Description of Artificial Sequence: Synthetic oligonucleotide
ggcaaagaacaaauaauaa

SEQ ID NO: 14251 - RNA, 21 nt, Artificial Sequence
  Description of Artificial Sequence: Synthetic oligonucleotide
uuauuauuuguucuuugccuu

SEQ ID NO: 14252 - RNA, 19 nt, Artificial Sequence
  Description of Artificial Sequence: Synthetic oligonucleotide
ggcaaagaacaaauaauaa

SEQ ID NO: 14253 - RNA, 21 nt, Artificial Sequence
  Description of Artificial Sequence: Synthetic oligonucleotide
uuauuauuuguucuuugccuu

SEQ ID NO: 14254 - RNA, 19 nt, Artificial Sequence
  Description of Artificial Sequence: Synthetic oligonucleotide
ggcaaagaacaaauaauaa

SEQ ID NO: 14255 - RNA, 21 nt, Artificial Sequence
  Description of Artificial Sequence: Synthetic oligonucleotide
uuauuauuuguucuuugccuu

SEQ ID NO: 14256 - RNA, 19 nt, Artificial Sequence
  Description of Artificial Sequence: Synthetic oligonucleotide
ggcaaagaacaaauaauaa

SEQ ID NO: 14257 - RNA, 21 nt, Artificial Sequence
  Description of Artificial Sequence: Synthetic oligonucleotide
uuauuauuuguucuuugccuu

SEQ ID NO: 14258 - RNA, 19 nt, Artificial Sequence
  Description of Artificial Sequence: Synthetic oligonucleotide
ggcaaagaacaaauaauaa

SEQ ID NO: 14259 - RNA, 21 nt, Artificial Sequence
  Description of Artificial Sequence: Synthetic oligonucleotide
uuauuauuuguucuuugccuu

SEQ ID NO: 14260 - RNA, 19 nt, Artificial Sequence
  Description of Artificial Sequence: Synthetic oligonucleotide
ggcaaagaacaaauaauaa

SEQ ID NO: 14261 - RNA, 21 nt, Artificial Sequence
  Description of Artificial Sequence: Synthetic oligonucleotide
uuauuauuuguucuuugccuu

SEQ ID NO: 14262 - RNA, 19 nt, Artificial Sequence
  Description of Artificial Sequence: Synthetic oligonucleotide
ggcaaagaacaaauaauaa

SEQ ID NO: 14263 - DNA, 21 bp, Artificial Sequence
  Description of Artificial Sequence: Synthetic oligonucleotide
  Description of Combined DNA/RNA Molecule: Synthetic oligonucleotide
uuauuauuuguucuuugcctt

SEQ ID NO: 14264 - RNA, 19 nt, Artificial Sequence
  Description of Artificial Sequence: Synthetic oligonucleotide
ggcaaagaacaaauaauaa

SEQ ID NO: 14265 - RNA, 21 nt, Artificial Sequence
  Description of Artificial Sequence: Synthetic oligonucleotide
uuauuauuuguucuuugccuu

SEQ ID NO: 14266 - RNA, 19 nt, Artificial Sequence
  Description of Artificial Sequence: Synthetic oligonucleotide
ggcaaagaacaaauaauaa

SEQ ID NO: 14267 - RNA, 21 nt, Artificial Sequence
  Description of Artificial Sequence: Synthetic oligonucleotide
uuauuauuuguucuuugccuu

SEQ ID NO: 14268 - RNA, 19 nt, Artificial Sequence
  Description of Artificial Sequence: Synthetic oligonucleotide
ggcaaagaacaaauaauaa

SEQ ID NO: 14269 - RNA, 21 nt, Artificial Sequence
  Description of Artificial Sequence: Synthetic oligonucleotide
uuauuauuuguucuuugccuu

SEQ ID NO: 14270 - RNA, 19 nt, Artificial Sequence
  Description of Artificial Sequence: Synthetic oligonucleotide
ggcaaagaacaaauaauaa

SEQ ID NO: 14271 - RNA, 21 nt, Artificial Sequence
  Description of Artificial Sequence: Synthetic oligonucleotide
uuauuauuuguucuuugccuu

SEQ ID NO: 14272 - RNA, 19 nt, Artificial Sequence
  Description of Artificial Sequence: Synthetic oligonucleotide
ggcaaagaacaaauaauaa

SEQ ID NO: 14273 - RNA, 21 nt, Artificial Sequence
  Description of Artificial Sequence: Synthetic oligonucleotide
uuauuauuuguucuuugccuu

SEQ ID NO: 14274 - RNA, 19 nt, Artificial Sequence
  Description of Artificial Sequence: Synthetic oligonucleotide
ggcaaagaacaaauaauaa

SEQ ID NO: 14275 - RNA, 21 nt, Artificial Sequence
  Description of Artificial Sequence: Synthetic oligonucleotide
uuauuauuuguucuuugccuu

SEQ ID NO: 14276 - RNA, 19 nt, Artificial Sequence
  Description of Artificial Sequence: Synthetic oligonucleotide
ggcaaagaacaaauaauaa

SEQ ID NO: 14277 - RNA, 21 nt, Artificial Sequence
  Description of Artificial Sequence: Synthetic oligonucleotide
uuauuauuuguucuuugccuu

SEQ ID NO: 14278 - RNA, 19 nt, Artificial Sequence
  Description of Artificial Sequence: Synthetic oligonucleotide
ggcaaagaacaaauaauaa

SEQ ID NO: 14279 - RNA, 21 nt, Artificial Sequence
  Description of Artificial Sequence: Synthetic oligonucleotide
uuauuauuuguucuuugccuu

SEQ ID NO: 14280 - RNA, 19 nt, Artificial Sequence
  Description of Artificial Sequence: Synthetic oligonucleotide
ggcaaagaacaaauaauaa

SEQ ID NO: 14281 - RNA, 21 nt, Artificial Sequence
  Description of Artificial Sequence: Synthetic oligonucleotide
uuauuauuuguucuuugccuu

SEQ ID NO: 14282 - RNA, 19 nt, Artificial Sequence
  Description of Artificial Sequence: Synthetic oligonucleotide
ggcaaagaacaaauaauaa

SEQ ID NO: 14283 - RNA, 21 nt, Artificial Sequence
  Description of Artificial Sequence: Synthetic oligonucleotide
uuauuauuuguucuuugccuu

SEQ ID NO: 14284 - RNA, 19 nt, Artificial Sequence
  Description of Artificial Sequence: Synthetic oligonucleotide
ggcaaagaacaaauaauaa

SEQ ID NO: 14285 - DNA, 21 bp, Artificial Sequence
  Description of Artificial Sequence: Synthetic oligonucleotide
  Description of Combined DNA/RNA Molecule: Synthetic oligonucleotide
utauuauuuguucuuugccuu

SEQ ID NO: 14286 - RNA, 19 nt, Artificial Sequence
  Description of Artificial Sequence: Synthetic oligonucleotide
ggcaaagaacaaauaauaa

SEQ ID NO: 14287 - DNA, 21 bp, Artificial Sequence
  Description of Artificial Sequence: Synthetic oligonucleotide
  Description of Combined DNA/RNA Molecule: Synthetic oligonucleotide
utauuauuuguucuuugccuu

SEQ ID NO: 14288 - RNA, 19 nt, Artificial Sequence
  Description of Artificial Sequence: Synthetic oligonucleotide
ggcaaagaacaaauaauaa

SEQ ID NO: 14289 - DNA, 21 bp, Artificial Sequence
  Description of Artificial Sequence: Synthetic oligonucleotide
  Description of Combined DNA/RNA Molecule: Synthetic oligonucleotide
utauuauuuguucuuugccuu

SEQ ID NO: 14290 - RNA, 19 nt, Artificial Sequence
  Description of Artificial Sequence: Synthetic oligonucleotide
ggcaaagaacaaauaauaa

SEQ ID NO: 14291 - DNA, 21 bp, Artificial Sequence
  Description of Artificial Sequence: Synthetic oligonucleotide
  Description of Combined DNA/RNA Molecule: Synthetic oligonucleotide
utauuauuuguucuuugccuu

SEQ ID NO: 14292 - RNA, 19 nt, Artificial Sequence
  Description of Artificial Sequence: Synthetic oligonucleotide
ggcaaagaacaaauaauaa

SEQ ID NO: 14293 - RNA, 21 nt, Artificial Sequence
  Description of Artificial Sequence: Synthetic oligonucleotide
uuauuauuuguucuuugccuu

SEQ ID NO: 14294 - RNA, 19 nt, Artificial Sequence
  Description of Artificial Sequence: Synthetic oligonucleotide
ggcaaagaacaaauaauaa

SEQ ID NO: 14295 - RNA, 21 nt, Artificial Sequence
  Description of Artificial Sequence: Synthetic oligonucleotide
uuauuauuuguucuuugccuu

SEQ ID NO: 14296 - RNA, 19 nt, Artificial Sequence
  Description of Artificial Sequence: Synthetic oligonucleotide
ggcaaagaacaaauaauaa

SEQ ID NO: 14297 - RNA, 21 nt, Artificial Sequence
  Description of Artificial Sequence: Synthetic oligonucleotide
uuauuauuuguucuuugccuu

SEQ ID NO: 14298 - RNA, 19 nt, Artificial Sequence
  Description of Artificial Sequence: Synthetic oligonucleotide
ggcaaagaacaaauaauaa

SEQ ID NO: 14299 - RNA, 21 nt, Artificial Sequence
  Description of Artificial Sequence: Synthetic oligonucleotide
uuauuauuuguucuuugccuu

SEQ ID NO: 14300 - RNA, 19 nt, Artificial Sequence
  Description of Artificial Sequence: Synthetic oligonucleotide
ggcaaagaacaaauaauaa

SEQ ID NO: 14301 - RNA, 21 nt, Artificial Sequence
  Description of Artificial Sequence: Synthetic oligonucleotide
uuauuauuuguucuuugccuu

SEQ ID NO: 14302 - RNA, 19 nt, Artificial Sequence
  Description of Artificial Sequence: Synthetic oligonucleotide
ggcaaagaacaaauaauaa

SEQ ID NO: 14303 - RNA, 21 nt, Artificial Sequence
  Description of Artificial Sequence: Synthetic oligonucleotide
uuauuauuuguucuuugccuu

SEQ ID NO: 14304 - RNA, 19 nt, Artificial Sequence
  Description of Artificial Sequence: Synthetic oligonucleotide
ggcaaagaacaaauaauaa

SEQ ID NO: 14305 - RNA, 21 nt, Artificial Sequence
  Description of Artificial Sequence: Synthetic oligonucleotide
uuauuauuuguucuuugccuu

SEQ ID NO: 14306 - RNA, 19 nt, Artificial Sequence
  Description of Artificial Sequence: Synthetic oligonucleotide
ggcaaagaacaaauaauaa

SEQ ID NO: 14307 - RNA, 21 nt, Artificial Sequence
  Description of Artificial Sequence: Synthetic oligonucleotide
uuauuauuuguucuuugccuu

SEQ ID NO: 14308 - RNA, 19 nt, Artificial Sequence
  Description of Artificial Sequence: Synthetic oligonucleotide
ggcaaagaacaaauaauaa

SEQ ID NO: 14309 - RNA, 21 nt, Artificial Sequence
  Description of Artificial Sequence: Synthetic oligonucleotide
uuauuauuuguucuuugccuu

SEQ ID NO: 14310 - RNA, 19 nt, Artificial Sequence
  Description of Artificial Sequence: Synthetic oligonucleotide
ggcaaagaacaaauaauaa

SEQ ID NO: 14311 - RNA, 21 nt, Artificial Sequence
  Description of Artificial Sequence: Synthetic oligonucleotide
uuauuauuuguucuuugccuu

SEQ ID NO: 14312 - RNA, 19 nt, Artificial Sequence
  Description of Artificial Sequence: Synthetic oligonucleotide
ggcaaagaacaaauaauaa

SEQ ID NO: 14313 - RNA, 21 nt, Artificial Sequence
  Description of Artificial Sequence: Synthetic oligonucleotide
uuauuauuuguucuuugccuu

SEQ ID NO: 14314 - RNA, 19 nt, Artificial Sequence
  Description of Artificial Sequence: Synthetic oligonucleotide
ggcaaagaacaaauaauaa

SEQ ID NO: 14315 - RNA, 21 nt, Artificial Sequence
  Description of Artificial Sequence: Synthetic oligonucleotide
uuauuauuuguucuuugccuu

SEQ ID NO: 14316 - RNA, 19 nt, Artificial Sequence
  Description of Artificial Sequence: Synthetic oligonucleotide
ggcaaagaacaaauaauaa

SEQ ID NO: 14317 - RNA, 21 nt, Artificial Sequence
  Description of Artificial Sequence: Synthetic oligonucleotide
uuauuauuuguucuuugccuu

SEQ ID NO: 14318 - RNA, 19 nt, Artificial Sequence
  Description of Artificial Sequence: Synthetic oligonucleotide
ggcaaagaacaaauaauaa

SEQ ID NO: 14319 - DNA, 21 bp, Artificial Sequence
  Description of Artificial Sequence: Synthetic oligonucleotide
  Description of Combined DNA/RNA Molecule: Synthetic oligonucleotide
utauuauuuguucuuugccuu

SEQ ID NO: 14320 - RNA, 19 nt, Artificial Sequence
  Description of Artificial Sequence: Synthetic oligonucleotide
ggcaaagaacaaauaauaa

SEQ ID NO: 14321 - RNA, 21 nt, Artificial Sequence
  Description of Artificial Sequence: Synthetic oligonucleotide
uuauuauuuguucuuugccuu

SEQ ID NO: 14322 - RNA, 19 nt, Artificial Sequence
  Description of Artificial Sequence: Synthetic oligonucleotide
ggcaaagaacaaauaauaa

SEQ ID NO: 14323 - RNA, 21 nt, Artificial Sequence
  Description of Artificial Sequence: Synthetic oligonucleotide
uuauuauuuguucuuugccuu

SEQ ID NO: 14324 - RNA, 19 nt, Artificial Sequence
  Description of Artificial Sequence: Synthetic oligonucleotide
ggcaaagaacaaauaauaa

SEQ ID NO: 14325 - DNA, 21 bp, Artificial Sequence
  Description of Artificial Sequence: Synthetic oligonucleotide
  Description of Combined DNA/RNA Molecule: Synthetic oligonucleotide
uuauuauuuguucuutgccuu

SEQ ID NO: 14326 - RNA, 19 nt, Artificial Sequence
  Description of Artificial Sequence: Synthetic oligonucleotide
ggcaaagaacaaauaauaa

SEQ ID NO: 14327 - DNA, 21 bp, Artificial Sequence
  Description of Artificial Sequence: Synthetic oligonucleotide
  Description of Combined DNA/RNA Molecule: Synthetic oligonucleotide
uuauuauuuguucuutgccuu

SEQ ID NO: 14328 - RNA, 19 nt, Artificial Sequence
  Description of Artificial Sequence: Synthetic oligonucleotide
ggcaaagaacaaauaauaa

SEQ ID NO: 14329 - DNA, 21 bp, Artificial Sequence
  Description of Artificial Sequence: Synthetic oligonucleotide
  Description of Combined DNA/RNA Molecule: Synthetic oligonucleotide
utauuauuuguucuuugccuu

SEQ ID NO: 14330 - RNA, 19 nt, Artificial Sequence
  Description of Artificial Sequence: Synthetic oligonucleotide
ggcaaagaacaaauaauaa

SEQ ID NO: 14331 - DNA, 21 bp, Artificial Sequence
  Description of Artificial Sequence: Synthetic oligonucleotide
  Description of Combined DNA/RNA Molecule: Synthetic oligonucleotide
utauuauuuguucuuugccuu

SEQ ID NO: 14332 - RNA, 19 nt, Artificial Sequence
  Description of Artificial Sequence: Synthetic oligonucleotide
ggcaaagaacaaauaauaa

SEQ ID NO: 14333 - DNA, 21 bp, Artificial Sequence
  Description of Artificial Sequence: Synthetic oligonucleotide
  Description of Combined DNA/RNA Molecule: Synthetic oligonucleotide
utauuauuuguucuuugccuu

SEQ ID NO: 14334 - RNA, 19 nt, Artificial Sequence
  Description of Artificial Sequence: Synthetic oligonucleotide
ggcaaagaacaaauaauaa

SEQ ID NO: 14335 - DNA, 21 bp, Artificial Sequence
  Description of Artificial Sequence: Synthetic oligonucleotide
  Description of Combined DNA/RNA Molecule: Synthetic oligonucleotide
uuauuauuuguuctutgccuu

SEQ ID NO: 14336 - RNA, 19 nt, Artificial Sequence
  Description of Artificial Sequence: Synthetic oligonucleotide
ggcaaagaacaaauaauaa

SEQ ID NO: 14337 - DNA, 21 bp, Artificial Sequence
  Description of Artificial Sequence: Synthetic oligonucleotide
  Description of Combined DNA/RNA Molecule: Synthetic oligonucleotide
uuauuauuuguuctutgccuu

SEQ ID NO: 14338 - RNA, 19 nt, Artificial Sequence
  Description of Artificial Sequence: Synthetic oligonucleotide
ggcaaagaacaaauaauaa

SEQ ID NO: 14339 - RNA, 21 nt, Artificial Sequence
  Description of Artificial Sequence: Synthetic oligonucleotide
uuauuauuuguucuuugccuu

SEQ ID NO: 14340 - RNA, 19 nt, Artificial Sequence
  Description of Artificial Sequence: Synthetic oligonucleotide
ggcaaagaacaaauaauaa

SEQ ID NO: 14341 - DNA, 21 bp, Artificial Sequence
  Description of Artificial Sequence: Synthetic oligonucleotide
  Description of Combined DNA/RNA Molecule: Synthetic oligonucleotide
utauuauuuguuctuugccuu

SEQ ID NO: 14342 - RNA, 19 nt, Artificial Sequence
  Description of Artificial Sequence: Synthetic oligonucleotide
ggcaaagaacaaauaauaa

SEQ ID NO: 14343 - DNA, 21 bp, Artificial Sequence
  Description of Artificial Sequence: Synthetic oligonucleotide
  Description of Combined DNA/RNA Molecule: Synthetic oligonucleotide
utauuauuuguuctuugccuu

SEQ ID NO: 14344 - RNA, 19 nt, Artificial Sequence
  Description of Artificial Sequence: Synthetic oligonucleotide
ggcaaagaacaaauaauaa

SEQ ID NO: 14345 - RNA, 19 nt, Artificial Sequence
  Description of Artificial Sequence: Synthetic oligonucleotide
ggcaaagaacaaauaauaa

SEQ ID NO: 14346 - RNA, 21 nt, Artificial Sequence
  Description of Artificial Sequence: Synthetic oligonucleotide
uuauuauuuguucuuugccuu

SEQ ID NO: 14347 - RNA, 19 nt, Artificial Sequence
  Description of Artificial Sequence: Synthetic oligonucleotide
ggcaaagaacaaauaauaa

SEQ ID NO: 14348 - RNA, 21 nt, Artificial Sequence
  Description of Artificial Sequence: Synthetic oligonucleotide
uuauuauuuguucuuugccuu

SEQ ID NO: 14349 - RNA, 19 nt, Artificial Sequence
  Description of Artificial Sequence: Synthetic oligonucleotide
ggcaaagaacaaauaauaa

SEQ ID NO: 14350 - RNA, 21 nt, Artificial Sequence
  Description of Artificial Sequence: Synthetic oligonucleotide
uuauuauuuguucuuugccuu

SEQ ID NO: 14351 - RNA, 19 nt, Artificial Sequence
  Description of Artificial Sequence: Synthetic oligonucleotide
ggcaaagaacaaauaauaa

SEQ ID NO: 14352 - RNA, 21 nt, Artificial Sequence
  Description of Artificial Sequence: Synthetic oligonucleotide
uuauuauuuguucuuugccuu

---

What is claimed is:

1. A compound, or a pharmaceutically acceptable salt or solvate thereof, having the structure of Formula (II):

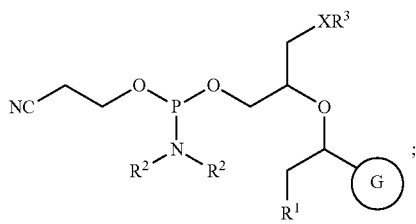

(II)

wherein:
Ring G is

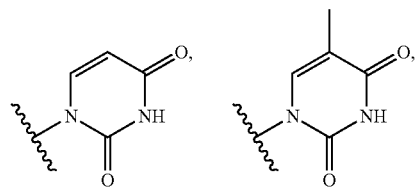

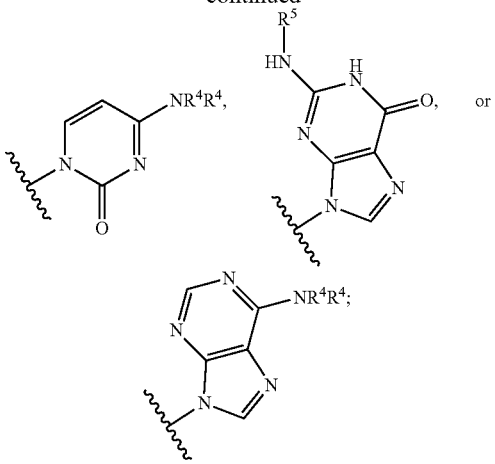

X is O, NH, or C(=O);
$R^1$ is hydrogen, deuterium, halogen, substituted or unsubstituted $C_1$-$C_{10}$ alkyl, substituted or unsubstituted $C_2$-$C_{10}$ alkenyl, substituted or unsubstituted $C_2$-$C_{10}$ alkynyl, substituted or unsubstituted $C_1$-$C_{10}$ fluoroalkyl, substituted or unsubstituted $C_1$-$C_{20}$ heteroalkyl, substituted or unsubstituted cycloalkyl, substituted or unsubstituted heterocycloalkyl, substituted or unsubstituted aryl, substituted or unsubstituted heteroaryl, substituted or unsubstituted —O-aryl, —OR$^6$, —C(=O)R$^6$, —C(=O)OR$^6$, —C(=O)NR$^7$R$^7$, —OCH$_2$C(=O)R$^6$, —OCH$_2$C(=O)OR$^6$, or —OCH$_2$C(=O)NR$^7$R$^7$;

each R$^2$ is independently hydrogen, deuterium, or substituted or unsubstituted C$_1$-C$_{10}$ alkyl;

or two R$^2$ are taken together with the nitrogen atom to which they are attached to form a substituted or unsubstituted C$_3$-C$_{10}$ heterocycloalkyl;

R$^3$ is hydrogen, 4,4'-dimethoxytrityl (DMT), —R$^6$, —OR$^6$, or —NR$^7$R$^7$;

each R$^4$ is independently hydrogen, substituted or unsubstituted C$_1$-C$_6$alkyl, substituted or unsubstituted aryl, or substituted or unsubstituted benzoyl;

R$^5$ is —C(=O)R$^6$;

each R$^6$ and R$^7$ are independently hydrogen, substituted or unsubstituted C$_1$-C$_6$alkyl, substituted or unsubstituted C$_1$-C$_6$fluoroalkyl, substituted or unsubstituted C$_3$-C$_6$cycloalkyl, substituted or unsubstituted heterocycloalkyl, substituted or unsubstituted aryl, or substituted or unsubstituted heteroaryl.

2. The compound of claim 1, or a pharmaceutically acceptable salt or solvate, thereof, wherein: R$^1$ is

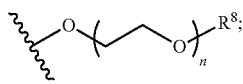

n is 0, 1, 2, 3, 4, or 5; and

R$^5$ is hydrogen or substituted or unsubstituted C$_1$-C$_3$ alkyl.

3. The compound of claim 1, or a pharmaceutically acceptable salt or solvate, thereof, wherein: R$^1$ is —OCH$_2$C(=O)NR$^7$R$^7$; wherein each R$^7$ is independently hydrogen or substituted or unsubstituted C$_1$-C$_3$ alkyl.

4. The compound of claim 1, or a pharmaceutically acceptable salt or solvate thereof, wherein:

Ring G is

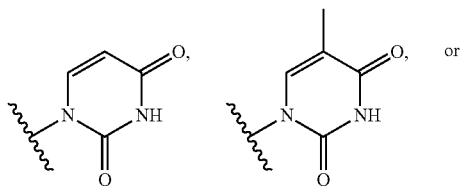

-continued

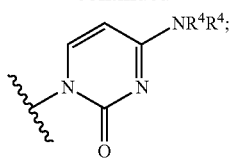

wherein each R$^4$ is independently hydrogen, or substituted or unsubstituted benzoyl.

5. The compound of claim 1, or a pharmaceutically acceptable salt or solvate thereof, wherein:

Ring G is

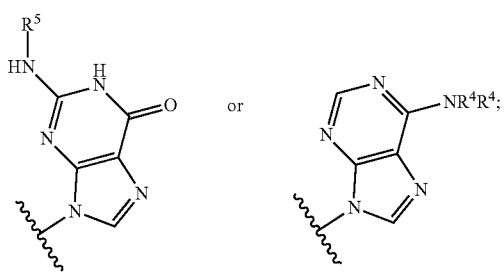

wherein each R$^4$ is independently hydrogen or substituted or unsubstituted benzoyl; and R$^5$ is —C(=O)R$^6$.

6. The compound of claim 1, or a pharmaceutically acceptable salt or solvate thereof, wherein each R$^2$ is independently isopropyl.

7. The compound of claim 1, or a pharmaceutically acceptable salt or solvate thereof, wherein two R$^2$ are taken together with the nitrogen atom to which they are attached to form a substituted or unsubstituted C$_3$-C$_{10}$ heterocycloalkyl.

8. The compound of claim 1, or a pharmaceutically acceptable salt or solvate thereof, wherein X is O; and R$^3$ is 4,4'-dimethoxytrityl (DMT).

* * * * *

UNITED STATES PATENT AND TRADEMARK OFFICE
CERTIFICATE OF CORRECTION

PATENT NO. : 12,006,499 B2
APPLICATION NO. : 16/894648
DATED : June 11, 2024
INVENTOR(S) : Doppalapudi et al.

Page 1 of 1

It is certified that error appears in the above-identified patent and that said Letters Patent is hereby corrected as shown below:

On the Title Page:

The first or sole Notice should read --

Subject to any disclaimer, the term of this patent is extended or adjusted under 35 U.S.C. 154(b) by 639 days.

Signed and Sealed this
Twenty-sixth Day of August, 2025

Coke Morgan Stewart
*Acting Director of the United States Patent and Trademark Office*